(12) United States Patent
Kim et al.

(10) Patent No.: US 11,214,803 B2
(45) Date of Patent: Jan. 4, 2022

(54) MODULATORS OF YAP1 EXPRESSION

(71) Applicant: Ionis Pharmaceuticals, Inc., Carlsbad, CA (US)

(72) Inventors: Youngsoo Kim, San Diego, CA (US); Xiaolin Luo, San Diego, CA (US); Robert MacLeod, San Diego, CA (US); Susan M. Freier, San Diego, CA (US); Huynh-Hoa Bui, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 20 days.

(21) Appl. No.: 16/778,949

(22) Filed: Jan. 31, 2020

(65) Prior Publication Data

US 2021/0123059 A1 Apr. 29, 2021

Related U.S. Application Data

(60) Provisional application No. 62/845,077, filed on May 8, 2019, provisional application No. 62/799,591, filed on Jan. 31, 2019.

(51) Int. Cl.
*C12N 15/113* (2010.01)
*A61K 9/00* (2006.01)
*A61K 45/00* (2006.01)
*A61P 35/00* (2006.01)

(52) U.S. Cl.
CPC ........ *C12N 15/1135* (2013.01); *A61K 9/0012* (2013.01); *A61K 45/00* (2013.01); *A61P 35/00* (2018.01); *C12N 2310/315* (2013.01); *C12N 2320/31* (2013.01)

(58) Field of Classification Search
CPC ...................... C12N 15/1135; C12N 2310/315
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |

(Continued)

FOREIGN PATENT DOCUMENTS

| | | |
|---|---|---|
| WO | WO 2009/054004 | 4/2009 |
| WO | WO 2011/017809 | 2/2011 |

(Continued)

OTHER PUBLICATIONS

Jho (J Thorac Dis 2018;10(Suppl 33):S3895-S3898) (Year: 2018).*
Sagaert et al (Pathobiology 85(1-2): 72-84, 2018) (Year: 2018).*
Nault et al (Clin Cancer Res; 21(8) Apr. 15, 2015) (Year: 2015).*
Zhu et al (Hepat Oncol. Jan. 2018; 5(1): HEP10, 4 pages) (Year: 2018).*
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.

(Continued)

*Primary Examiner* — Richard A Schnizer
(74) *Attorney, Agent, or Firm* — Sheppard Mullin Richter & Hampton LLP

(57) ABSTRACT

The present embodiments provide methods, compounds, and compositions useful for inhibiting YAP1 expression, which may be useful for treating, preventing, or ameliorating a cancer associated with YAP1.

23 Claims, No Drawings
Specification includes a Sequence Listing.

(56) References Cited

U.S. PATENT DOCUMENTS

| | | |
|---|---|---|
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,666,854 B2 | 2/2010 | Seth et al. |
| 7,687,616 B1 | 3/2010 | Bentwich et al. |
| 7,696,334 B1 | 4/2010 | Bentwich et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,090,542 B2 | 1/2012 | Khvorova et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,178,503 B2 | 5/2012 | Rigoutsos et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,486,903 B2 | 7/2013 | Hong et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,725,769 B1 | 8/2017 | Knudsen et al. |
| 2001/0053519 A1 | 12/2001 | Fodor et al. |
| 2003/0082807 A1 | 5/2003 | Wengel |
| 2003/0158403 A1 | 8/2003 | Manoharan et al. |
| 2003/0175906 A1 | 9/2003 | Manoharan et al. |
| 2003/0207841 A1 | 11/2003 | Kaneko et al. |
| 2003/0002243 A1 | 12/2003 | Wengel et al. |
| 2003/0228597 A1 | 12/2003 | Cowsert et al. |
| 2004/0143114 A1 | 7/2004 | Imanishi et al. |
| 2004/0171570 A1 | 9/2004 | Allerson et al. |
| 2004/0192918 A1 | 9/2004 | Imanishi et al. |
| 2005/0130923 A1 | 6/2005 | Bhat et al. |

(56) References Cited

U.S. PATENT DOCUMENTS

| | | |
|---|---|---|
| 2005/0244851 A1 | 11/2005 | Blume et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2010/0331392 A1 | 12/2010 | Monia et al. |
| 2011/0035814 A1 | 2/2011 | Zender et al. |
| 2011/0123520 A1 | 5/2011 | Manoharan et al. |
| 2013/0130378 A1 | 5/2013 | Manoharan et al. |
| 2013/0203836 A1 | 8/2013 | Rajeev et al. |
| 2014/0107330 A1 | 4/2014 | Freier et al. |
| 2015/0018540 A1 | 1/2015 | Prakash et al. |
| 2015/0141320 A1 | 5/2015 | Krieg et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2016/0145624 A1 | 5/2016 | Chae et al. |
| 2017/0204407 A1 | 7/2017 | Gilbert et al. |
| 2018/0021306 A1 | 1/2018 | Pan et al. |

FOREIGN PATENT DOCUMENTS

| | | |
|---|---|---|
| WO | WO 2013/173637 | 11/2013 |
| WO | WO 2017/05 3722 | 3/2017 |
| WO | WO 2017/160990 | 9/2017 |
| WO | WO 2017/197104 | 11/2017 |

OTHER PUBLICATIONS

Crooke, St., et al., "Antisense Drug Technology" Second Edition, CRC Press (2008) Chapters 1-28.

Diep et al., "Down-Regulation of Yes Associated Protein 1 Expression Reduces Cell Proliferation and Clonogenicity of Pancreatic Cancer Cells" PLOS One (2012) 7(30: e32783.

Egli, et al., "Synthesis, improved antisense activity and structural rationale for the divergent RNA affinities of 3'-fluoro hexitol nucleic acid (FHNAand Ara-FHNA) modified oligonucleotides." J Am Chem (2011) 133(41):16642-16649.

Gautschi et al., "Activity of a novel bcl-2/bcl-xLbispecific antisense oligonucleotide against tumors of diverse histologic origins" J. Natl. Cancer Inst. (2001) 93:463-471.

Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.

New England Biolabs 1998/99 Catalog (cover page and pp. 121 and 284).

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Woolf et al., "Specificity of antisense oligonucleotides in vivo" PNAS (1992) 89: 7305-7309.

International Search Report for PCT/US20/16182 dated Jun. 12, 2020.

Kim et al., "Abstract B197: Selective depletion of YAP1 with next-generation antisense oligonucleotides leads to immune cell infiltration and tumor regression in mouse models of HCC" Molecular Targets and Cancer Therapeutics (2018).

* cited by examiner

MODULATORS OF YAP1 EXPRESSION

SEQUENCE LISTING

The present application is being filed along with a Sequence Listing in electronic format. The Sequence Listing is provided as a file entitled BIOL0352USSEQ_ST25.txt created Jan. 31, 2020, which is 814 kb in size. The information in the electronic format of the sequence listing is incorporated herein by reference in its entirety.

FIELD

The present embodiments provide methods, compounds, and compositions useful for inhibiting YAP1 expression, which can be useful for treating, preventing, or ameliorating a cancer associated with YAP1.

BACKGROUND

Yes-associated protein (YAP1) is a transcriptional coactivator that is frequently activated in multiple human cancer types due to alterations in the tumor suppressive 'Hippo' pathway or its amplification. YAP1 is the downstream regulator of the Hippo pathway and promotes tumor growth through both tumor autonomous and immune-regulatory mechanisms. An active Hippo pathway is tumor suppresive and phosphorylates YAP1, resulting in its inactivation. When the Hippo pathway is inactive, YAP1 is dephosphorylated and translocated into the nucleus where it promotes expression of multiple genes.

SUMMARY

Certain embodiments provided herein are directed to potent and tolerable compounds and compositions useful for inhibiting YAP1 expression, which can be useful for treating, preventing, ameliorating, or slowing progression of cancer associated with YAP1.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE and 2'-O(CH$_2$)$_2$—OCH$_3$) refers to an O-methoxy-ethyl modification at the 2' position of a furanosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within ±10% of a value. For example, if it is stated, "the compounds affected about 70% inhibition of YAP1", it is implied that YAP1 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody," as used in this disclosure, refers to an immunoglobulin or a fragment or a derivative thereof, and encompasses any polypeptide comprising an antigen-binding site, regardless of whether it is produced in vitro or in vivo. The term includes, but is not limited to, polyclonal, monoclonal, monospecific, polyspecific, non-specific, humanized, single-chain, chimeric, synthetic, recombinant, hybrid, mutated, and grafted antibodies. Unless otherwise modified by the term "intact," as in "intact antibodies," for the purposes of this disclosure, the term "antibody" also includes antibody fragments such as Fab, F(ab')2, Fv, scFv, Fd, dAb, and other antibody fragments that retain antigen-binding function, i.e., the ability to bind, for example, CTLA-4 or PD-L1 specifically. Typically, such fragments would comprise an antigen-binding domain.

"Anti-CTLA-4 antibody" refers to an antibody or antigen binding fragment thereof that specifically binds a CTLA-4 polypeptide. Exemplary anti-CTLA-4 antibodies are described for example at U.S. Pat. Nos. 6,682,736; 7,109,003; 7,123,281; 7,411,057; 7,824,679; 8,143,379; 7,807,797; and 8,491,895 (Tremelimumab is 11.2.1, therein), which are herein incorporated by reference. Tremelimumab (U.S. Pat. No. 6,682,736) is an exemplary anti-CTLA-4 antibody. Tremelimumab VL, VH, and CDR amino acid sequences are provided at SEQ ID NOs: 1-8, herein.

"Anti-OX40 antibody" refers to an antibody or antigen binding fragment thereof that specifically binds OX40. OX40 antibodies include monoclonal and polyclonal antibodies that are specific for OX40 and antigen-binding fragments thereof. In certain aspects, anti-OX40 antibodies as described herein are monoclonal antibodies (or antigen-binding fragments thereof), e.g., murine, humanized, or fully human monoclonal antibodies. In one particular embodiment, the OX40 antibody is an OX40 receptor agonist, such as the mouse anti-human OX40 monoclonal antibody (9B12) described by Weinberg et al., J Immunother 29, 575-585 (2006). In another embodiment, an OX40 antibody is MEDI0562 as described in US 2016/0137740, incorporated herein by reference. MEDI0562 VH and VL amino acid sequences are provided at SEQ ID NOs: 25-26, herein. In other embodiments, the antibody which specifically binds to OX40, or an antigen-binding fragment thereof, binds to the same OX40 epitope as mAb 9B12.

"Anti-PD-L1 antibody" refers to an antibody or antigen binding fragment thereof that specifically binds a PD-L1 polypeptide. Exemplary anti-PD-L1 antibodies are described for example at US2013/0034559, U.S. Pat. Nos. 8,779,108 and 9,493,565 which are herein incorporated by reference. Durvalumab (MEDI4736) is an exemplary anti-PD-L1 antibody. Durvalumab VL, VH, and CDR amino acid sequences are provided at SEQ ID NOs: 9-16, herein. Other anti-PD-L1 antibodies include BMS-936559 (Bristol-Myers Squibb) and MPDL3280A (atezolizumab) (Roche).

"Anti-PD-1 antibody" refers to an antibody or antigen binding fragment thereof that specifically binds a PD-1 polypeptide. Exemplary anti-PD-1 antibodies are described for example at U.S. Pat. Nos. 7,521,051; 8,008,449; 8,354,509; 9,073,994; 9,393,301; 9,402,899; and 9,439,962, which are herein incorporated by reference. Exemplary anti-PD-1 antibodies include, without limitation, nivolumab, pembrolizumab, pidilizumab, and AMP-514.

"Antigen-binding domain," "antigen-binding fragment," and "binding fragment" refer to a part of an antibody molecule that comprises amino acids responsible for the specific binding between the antibody and the antigen. In instances, where an antigen is large, the antigen-binding domain may only bind to a part of the antigen. A portion of the antigen molecule that is responsible for specific interactions with the antigen-binding domain is referred to as "epitope" or "antigenic determinant." An antigen-binding domain typically comprises an antibody light chain variable region (VL) and an antibody heavy chain variable region (VH), however, it does not necessarily have to comprise both. For example, a so-called Fd antibody fragment consists only of a VH domain, but still retains some antigen-binding function of the intact antibody. Binding fragments of an antibody are produced by recombinant DNA techniques, or by enzymatic or chemical cleavage of intact antibodies. Binding fragments include Fab, Fab', F(ab')2, Fv, and single-chain antibodies. An antibody other than a "bispecific" or "bifunctional" antibody is understood to have each of its binding sites identical. Digestion of antibodies with the enzyme, papain, results in two identical antigen-binding fragments, known also as "Fab" fragments, and a "Fc" fragment, having no antigen-binding activity but having the ability to crystallize. Digestion of antibodies with the enzyme, pepsin, results in the a F(ab')2 fragment in which the two arms of the antibody molecule remain linked and comprise two-antigen binding sites. The F(ab')2 fragment has the ability to crosslink antigen. "Fv" when used herein refers to the minimum fragment of an antibody that retains both antigen-recognition and antigen-binding sites. "Fab" when used herein refers to a fragment of an antibody that comprises the constant domain of the light chain and the CH1 domain of the heavy chain.

"mAb" refers to monoclonal antibody. Antibodies of the present disclosure comprise without limitation whole native antibodies, bispecific antibodies; chimeric antibodies; Fab, Fab', single chain V region fragments (scFv), fusion polypeptides, and unconventional antibodies.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a bicyclic furanosyl sugar moiety comprising a bridge connecting the 4'-carbon and the 2'-carbon, wherein the bridge has the formula: 4'-CH(CH$_3$)—O-2'.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more sterorandom chiral centers. In certain embodiments, the molecules are modified oligonucleotides. In certain embodiments, the molecules are compounds comprising modified oligonucleotides.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating YAP1 RNA can mean to increase or decrease the level of YAP1 RNA and/or YAP1 protein in a cell, tissue, organ or organism. A "modulator" effects the change in the cell, tissue, organ or organism. For example, a YAP1 compound can be a modulator that decreases the amount of YAP1 RNA and/or YAP1 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide. "Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof "Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"YAP1" means any nucleic acid or protein of YAP1. "YAP1 nucleic acid" means any nucleic acid encoding YAP1. For example, in certain embodiments, a YAP1 nucleic acid includes a DNA sequence encoding YAP1, an RNA sequence transcribed from DNA encoding YAP1 (including genomic DNA comprising introns and exons), and an mRNA sequence encoding YAP1. "YAP1 mRNA" means an mRNA encoding a YAP1 protein. The target may be referred to in either upper or lower case.

"YAP1 specific inhibitor" refers to any agent capable of specifically inhibiting YAP1 RNA and/or YAP1 protein expression or activity at the molecular level. For example, YAP1 specific inhibitors include nucleic acids (including antisense compounds), peptides, antibodies, small molecules, and other agents capable of inhibiting the expression of YAP1 RNA and/or YAP1 protein.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

Certain Embodiments

Certain embodiments provide methods, compounds and compositions for inhibiting YAP1 expression.

Certain embodiments provide compounds targeted to a YAP1 nucleic acid. In certain embodiments, the YAP1 nucleic acid has the sequence set forth in RefSeq or GENBANK Accession No. NM_001282101.1 (SEQ ID NO: 1) or NC_000011.10 truncated from nucleotides 102107001 to 102236000 (SEQ ID NO: 2), each of which is incorporated by reference in its entirety. In certain embodiments, the compound is an antisense compound or oligomeric compound. In certain embodiments, the compound is single-stranded. In certain embodiments, the compound is double-stranded.

Certain embodiments provide a compound comprising a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 9 to 80 linked nucleosides and having a nucleobase sequence comprising at least 9 contiguous nucleobases of any of the nucleobase sequences of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 10 to 80 linked nucleosides and having a nucleobase sequence comprising at least 10 contiguous nucleobases of any of the nucleobase sequences of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 11 to 80 linked nucleosides and having a nucleobase sequence comprising at least 11 contiguous nucleobases of any of the nucleobase sequences of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 11 to 30 linked nucleosides.

Certain embodiments provide a compound comprising a modified oligonucleotide consisting of 12 to 80 linked nucleosides and having a nucleobase sequence comprising at least 12 contiguous nucleobases of any of the nucleobase sequences of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 12 to 30 linked nucleosides.

Certain embodiments provide a compound comprising a modified oligonucleotide consisting of 16 to 80 linked nucleosides and having a nucleobase sequence comprising the nucleobase sequence of any one of SEQ ID NOs: 23-2940. In certain embodiments, the compound is an antisense compound or oligomeric compound. In certain embodiments, the compound is single-stranded. In certain embodiments, the compound is double-stranded. In certain embodiments, the modified oligonucleotide consists of 16 to 30 linked nucleosides.

Certain embodiments provide a compound comprising a modified oligonucleotide having a nucleobase sequence consisting of the nucleobase sequence of any one of SEQ ID NOs: 23-2940. In certain embodiments, the compound is an antisense compound or oligomeric compound. In certain embodiments, the compound is single-stranded. In certain embodiments, the compound is double-stranded.

In certain embodiments, a compound comprises a modified oligonucleotide consisting of 8 to 80 linked nucleosides wherein the nucleobase sequence of the modified oligonucleotide comprises an at least 8, 9, 10, 11, 12, 13, 14, 15, or 16 contiguous nucleobase portion complementary to an equal length portion within nucleotides 2565-2580, 2566-2581, or 4600-4615 of SEQ ID NO: 1. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides wherein the nucleobase sequence of the modified oligonucleotide comprises an at least 8, 9, 10, 11, 12, 13, 14, 15, or 16 contiguous nucleobase portion complementary to an equal length portion within nucleotides 123590-123605, 117330-117345, 117761-117776, 117757-117772, 117758-117773, 117330-117345, 119672-119687, 123591-123606, 125625-125640, or 117755-117770 of SEQ ID NO: 2. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides wherein the nucleobase sequence of the modified oligonucleotide is complementary within nucleotides 2565-2580, 2566-2581, or 4600-4615 of SEQ ID NO: 1. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides wherein the nucleobase sequence of the modified oligonucleotide is complementary within nucleotides 123590-123605, 117330-117345, 117761-117776, 117757-117772, 117758-117773, 117330-117345, 119672-119687, 123591-123606, 125625-125640, or 117755-117770 of SEQ ID NO: 2. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides wherein the nucleobase sequence of the modified oligonucleotide comprises an at least 8, 9, 10, 11, 12, 13, 14, 15, or 16 contiguous nucleobase portion of any one of the nucleobase sequences of SEQ ID NOs: 810, 1404, 2868, 2864, 2865, 1404, 1101, 2812, 1200, or 2863. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the modified oligonucleotide consists of 16 to 30 linked nucleosides.

In certain embodiments, a compound comprises a modified oligonucleotide consisting of 16 linked nucleosides and having a nucleobase sequence consisting of the nucleobase sequence of any one of SEQ ID NOs: 810, 1404, 2868, 2864, 2865, 1404, 1101, 2812, 1200, or 2863.

In certain embodiments, a compound targeted to YAP1 is ION 1198440. Out of over 3,000 compounds that were screened as described in the Examples section below, ION 958499, 1076453, 1197270, 1198439, 1198440, 1198605, 1198623, 1198728, 1198831, or 1198872 emerged as the top lead compounds. In particular, ION 1198440 exhibited the best combination of properties in terms of potency and tolerability out of over 3,000 compounds.

In certain embodiments, any of the foregoing modified oligonucleotides has at least one modified internucleoside linkage, at least one modified sugar, and/or at least one modified nucleobase.

In certain embodiments, at least one nucleoside of any of the foregoing modified oligonucleotides comprises a modified sugar. In certain embodiments, the modified sugar comprises a 2'-O-methoxyethyl group. In certain embodiments, the modified sugar is a bicyclic sugar, such as a 4'-CH(CH$_3$)—O-2' group, a 4'-CH$_2$—O-2' group, or a 4'-(CH$_2$)$_2$—O-2'group.

In certain embodiments, at least one internucleoside linkage of the modified oligonucleotide is a modified internucleoside linkage, such as a phosphorothioate internucleoside linkage.

In certain embodiments, at least one nucleobase of the foregoing modified oligonucleotides is a modified nucleobase, such as 5-methylcytosine.

In certain embodiments, any of the foregoing modified oligonucleotides has:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide consists of 16 to 80 linked nucleosides and has a nucleobase sequence comprising the nucleobase sequence recited in any one of SEQ ID NOs: 810, 1404, 2868, 2864, 2865, 1404, 1101, 2812, 1200, or 2863.

In certain embodiments, the modified oligonucleotide consists of 16 to 30 linked nucleosides and has a nucleobase sequence comprising the nucleobase sequence recited in any one of SEQ ID NOs: 810, 1404, 2868, 2864, 2865, 1404, 1101, 2812, 1200, or 2863. In certain embodiments, the modified oligonucleotide consists of 16 linked nucleosides and has a nucleobase sequence consisting of the nucleobase sequence recited in any one of SEQ ID NOs: 810, 1404, 2868, 2864, 2865, 1404, 1101, 2812, 1200, or 2863.

In certain embodiments, a compound comprises or consists of a modified oligonucleotide consisting of 16 to 80 linked nucleobases and having a nucleobase sequence comprising the nucleobase sequence recited in any one of SEQ ID NOs: 23-2940, wherein the modified oligonucleotide has:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in any one of SEQ ID NOs: 810, 1404, 2868, 2864, 2865, 1404, 1101, 2812, 1200, or 2863, wherein the modified oligonucleotide has:

a gap segment consisting of linked 2'-deoxynucleosides;

a 5' wing segment consisting of linked nucleosides; and a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in any one of SEQ ID NOs: 810 and 1404, wherein the modified oligonucleotide has:

a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NO: 2868, wherein the modified oligonucleotide has a gapmer consisting of a 5'-region, a 3'-region, and a central region positioned between the 5'-region and the 3'-region wherein:

the 5'-region consists of 3 linked modified nucleosides, wherein each nucleoside of the 5'-region comprises a cEt nucleoside;

the 3'-region consists of 3 linked modified nucleosides, wherein each nucleoside of the 3'-region comprises a cEt nucleoside;

the central region consists of 10 linked nucleosides, wherein the second nucleoside from the 5' end of the central region comprises a 2'-O-methyl modified sugar moiety and the first and third through tenth nucleosides from the 5' end of the central region each comprises a 2'deoxynucleoside;

wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide having a nucleobase sequence comprising the nucleobase sequence recited in SEQ ID NO: 2868; wherein the modified oligonucleotide comprises the sugar motif kkk-d-y-d(8)-kkk, wherein "k" indicates a cEt modified sugar moiety, "d" indicates an unmodified 2'-deoxyribosyl sugar moiety, and "y" indicates a 2'-O-methyl modified sugar moiety; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of ION 1197270 having the nucleobase sequence and chemical motif: TksTksAksAdsAysGdsTdsGdsTdsAdsTdsGdsTdsmCksAksGk, wherein "d" represents a 2'-deoxyribose sugar, "k" represents a cEt modified sugar, "y" represents a 2'-O-methyl sugar, "s" represents a phosphorothioate internucleoside linkage, and "mC" refers to a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NO: 2864, wherein the modified oligonucleotide has:

a gap segment consisting of ten linked 2'-deoxynucleosides;

a 5' wing segment consisting of one linked nucleoside; and a 3' wing segment consisting of five linked nucleosides;

wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NOs: 1404 or 1101, wherein the modified oligonucleotide has:

a gap segment consisting of nine linked 2'-deoxynucleosides;

a 5' wing segment consisting of three linked nucleosides; and a 3' wing segment consisting of four linked nucleosides;

wherein the gap segment is positioned between the 5' wing segment and the 3' wing segment; wherein each nucleoside of the 5' wing segment comprises a cEt nucleoside; wherein the 3' wing segment comprises a cEt nucleoside, a cEt nucleoside, a cEt nucleoside, and a 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NO: 2812, wherein the modified oligonucleotide has:

a gap segment consisting of nine linked 2'-deoxynucleosides;

a 5' wing segment consisting of three linked nucleosides; and a 3' wing segment consisting of four linked nucleosides;

wherein the gap segment is positioned between the 5' wing segment and the 3' wing segment; wherein the 5' wing segment comprises a cEt nucleoside, a 2'-O-methoxyethyl nucleoside, and a cEt nucleoside in the 5' to 3' direction; wherein the 3' wing segment comprises a 2'-O-methoxyethyl nucleoside, a 2'-O-methoxyethyl nucleoside, a cEt nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NOs: 1200 or 2863, wherein the modified oligonucleotide has:

a gap segment consisting of nine linked 2'-deoxynucleosides;

a 5' wing segment consisting of two linked nucleosides; and a 3' wing segment consisting of five linked nucleosides;

wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in SEQ ID NO: 2865, wherein the modified oligonucleotide has:

a gap segment consisting of ten linked 2'-deoxynucleosides;

a 5' wing segment consisting of one linked nucleoside; and a 3' wing segment consisting of five linked nucleosides;

wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

Certain embodiments provide a modified oligonucleotide, wherein the anion form of the modified oligonucleotide has the following chemical structure:

(SEQ ID NO: 2865)

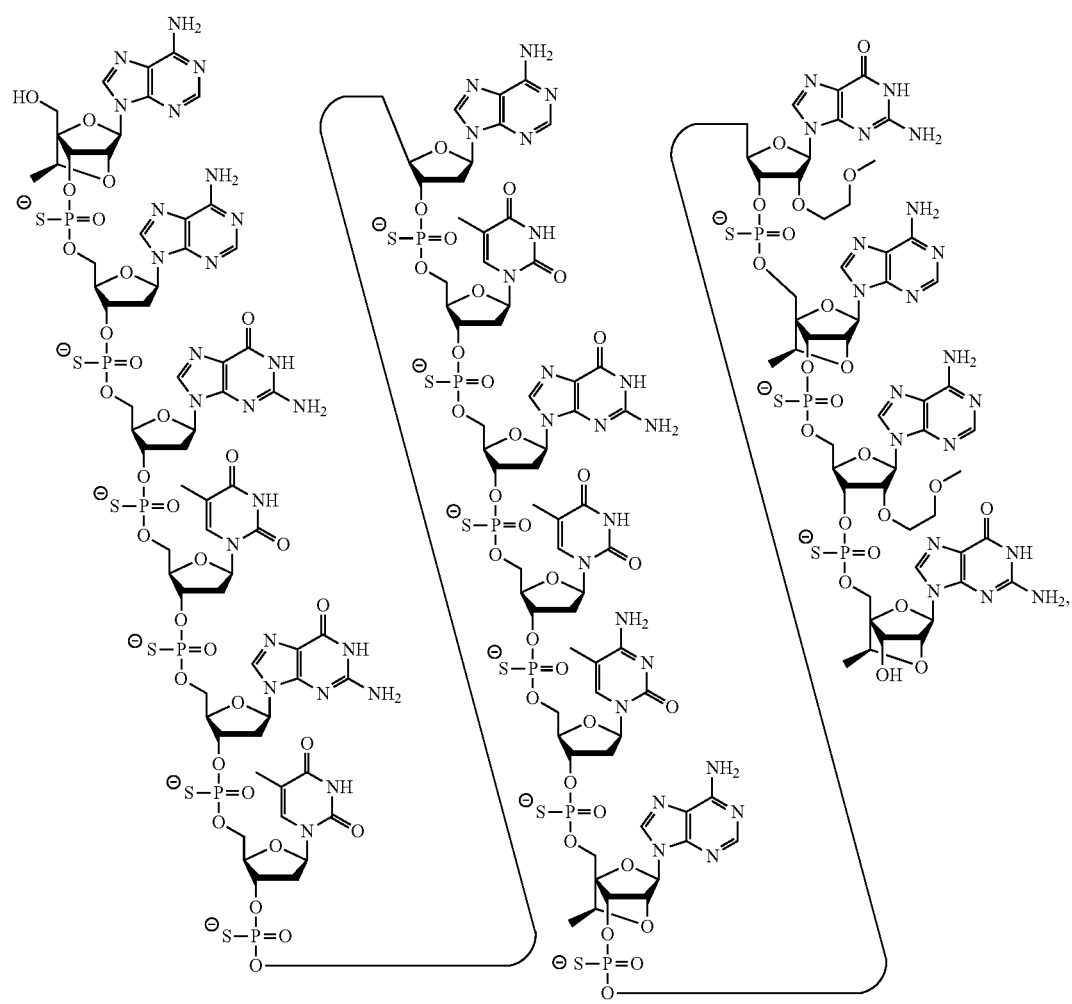

or a salt thereof.

Certain embodiments provide a modified oligonucleotide according to the following chemical structure:
(SEQ ID NO: 2865)
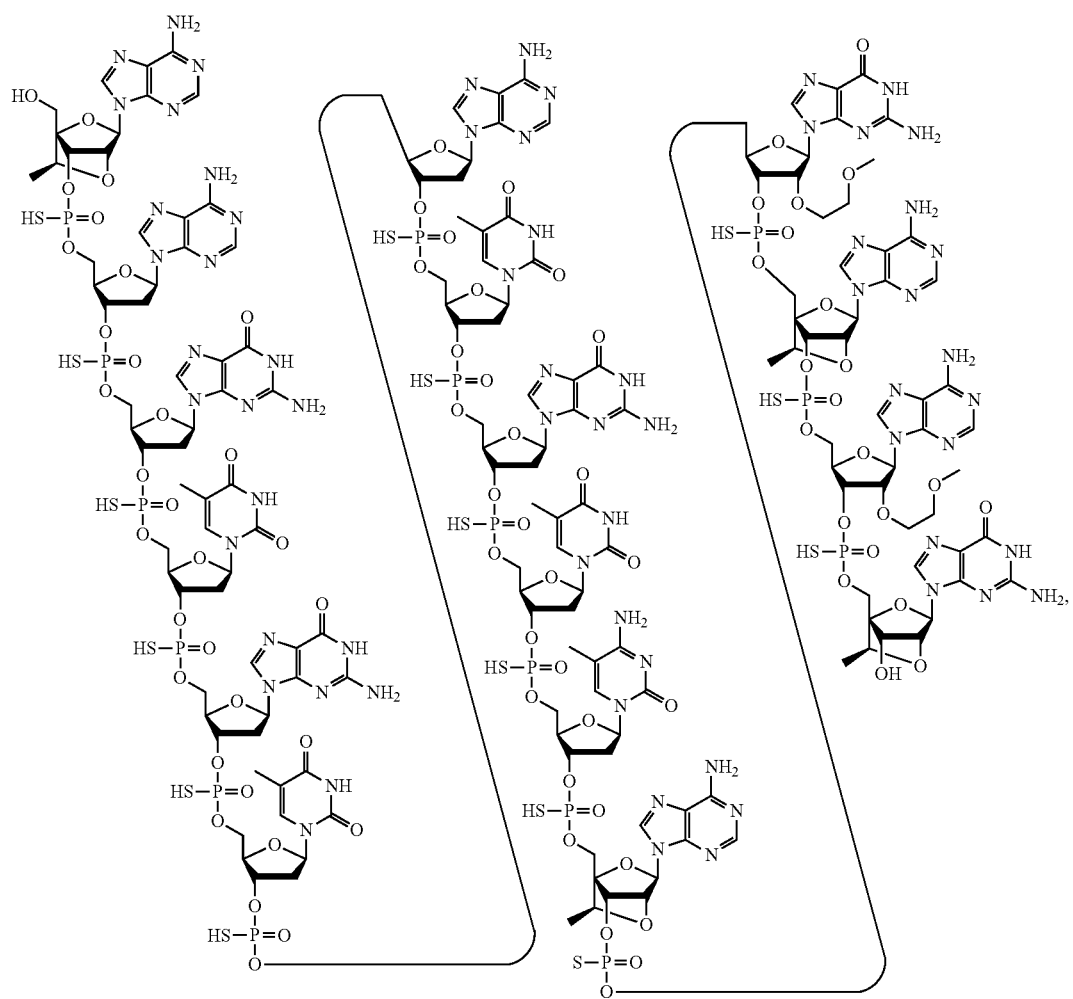
or a salt thereof.

Certain embodiments provide a modified oligonucleotide according to the following chemical structure:

(SEQ ID NO: 2865)

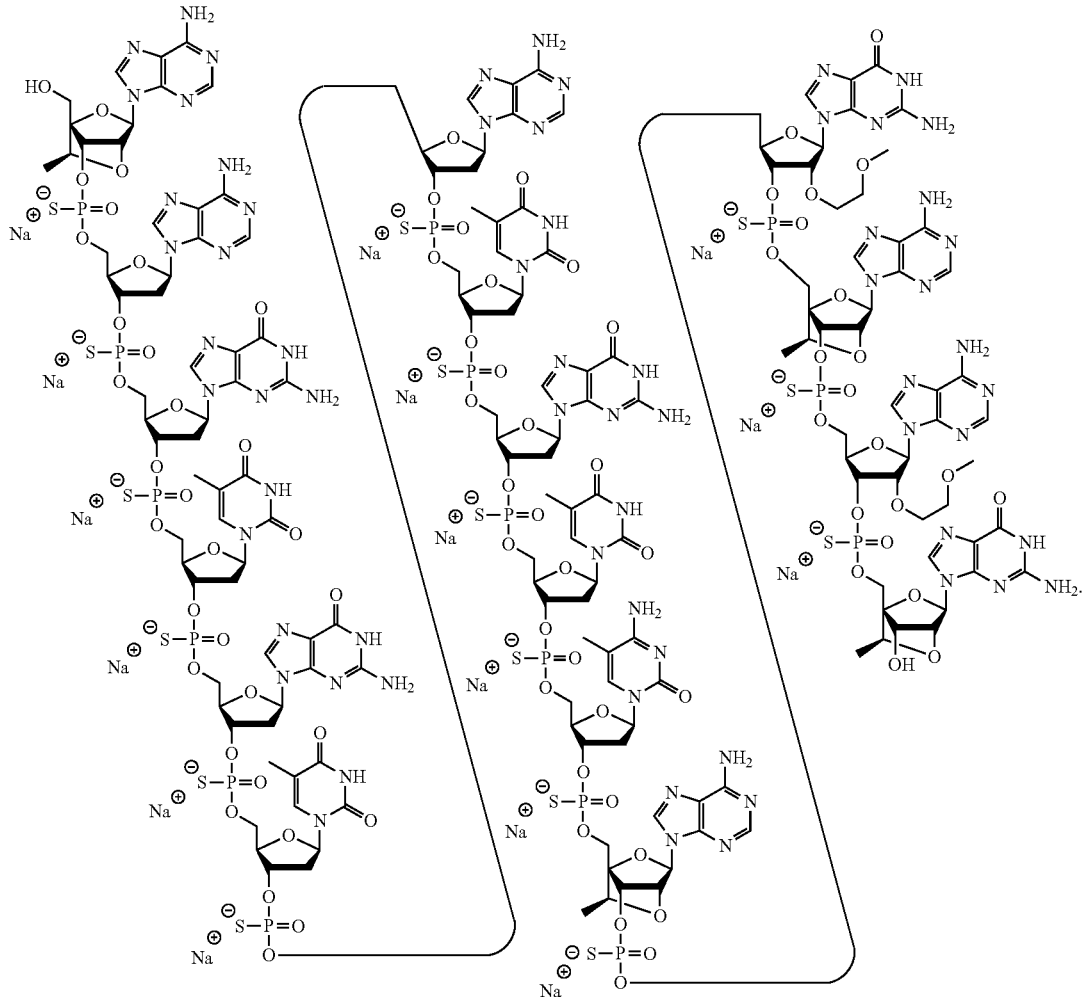

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. Unless otherwise indicated, an oligonucleotide described herein and the term "oligonucleotide" are intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In any of the foregoing embodiments, the compound or oligonucleotide can be at least 85%, at least 90%, at least 95%, at least 98%, at least 99%, or 100% complementary to a nucleic acid encoding YAP1.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can consist of 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides. In certain embodiments, the compound comprises or consists of an oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Non-limiting numbered embodiments include:

E1. A compound comprising a modified oligonucleotide consisting of 8 to 80 linked nucleosides having a nucleobase sequence comprising at least 8 contiguous nucleobases of any of the nucleobase sequences of SEQ ID NOs: 23-2940.

E2. A compound comprising a modified oligonucleotide 9 to 80 linked nucleosides in length having a nucleobase sequence comprising at least 9 contiguous nucleobases of any of the nucleobase sequences of SEQ ID NOs: 23-2940.

E3. A compound comprising a modified oligonucleotide 10 to 80 linked nucleosides in length having a nucleobase sequence comprising at least 10 contiguous nucleobases of any of the nucleobase sequences of SEQ ID NOs: 23-2940.

E4. A compound comprising a modified oligonucleotide 11 to 80 linked nucleosides in length having a nucleobase sequence comprising at least 11 contiguous nucleobases of any of the nucleobase sequences of SEQ ID NOs: 23-2940.

E5. A compound comprising a modified oligonucleotide 12 to 80 linked nucleosides in length having a nucleobase sequence comprising at least 12 contiguous nucleobases of any of the nucleobase sequences of SEQ ID NOs: 23-2940.

E6. A compound comprising a modified oligonucleotide consisting of 16 to 80 linked nucleosides having a nucleobase sequence comprising the nucleobase sequence of any one of SEQ ID NOs: 23-2940.

E7. A compound comprising a modified oligonucleotide having a nucleobase sequence consisting of the nucleobase sequence of any one of SEQ ID NOs: 23-2940.

E8. A compound comprising a modified oligonucleotide consisting of 8 to 80 linked nucleosides complementary within nucleotides 2565-2580, 2566-2581, or 4600-4615 of SEQ ID NO: 1 or within nucleotides 123590-123605, 117330-117345, 117761-117776, 117757-117772, 117758-117773, 117330-117345, 119672-119687, 123591-123606, 125625-125640, or 117755-117770 of SEQ ID NO: 2.

E9. A compound comprising a modified oligonucleotide consisting of 8 to 80 linked nucleosides having a nucleobase sequence comprising at least 8 contiguous nucleobases of any of the nucleobase sequences of SEQ ID NOs: 810, 1404, 2868, 2864, 2865, 1404, 1101, 2812, 1200, or 2863.

E10. A compound comprising a modified oligonucleotide 9 to 80 linked nucleosides in length having a nucleobase sequence comprising at least 9 contiguous nucleobases of any of the nucleobase sequences of SEQ ID NOs: 810, 1404, 2868, 2864, 2865, 1404, 1101, 2812, 1200, or 2863.

E11. A compound comprising a modified oligonucleotide 10 to 80 linked nucleosides in length having a nucleobase sequence comprising at least 10 contiguous nucleobases of any of the nucleobase sequences of SEQ ID NOs: 810, 1404, 2868, 2864, 2865, 1404, 1101, 2812, 1200, or 2863.

E12. A compound comprising a modified oligonucleotide 11 to 80 linked nucleosides in length having a nucleobase sequence comprising at least 11 contiguous nucleobases of any of the nucleobase sequences of SEQ ID NOs: 810, 1404, 2868, 2864, 2865, 1404, 1101, 2812, 1200, or 2863.

E13. A compound comprising a modified oligonucleotide 12 to 80 linked nucleosides in length having a nucleobase sequence comprising at least 12 contiguous nucleobases of any of the nucleobase sequences of SEQ ID NOs: 810, 1404, 2868, 2864, 2865, 1404, 1101, 2812, 1200, or 2863.

E14. A compound comprising a modified oligonucleotide consisting of 8 to 80 linked nucleosides having a nucleobase sequence comprising any one of SEQ ID NOs: 810, 1404, 2868, 2864, 2865, 1404, 1101, 2812, 1200, or 2863.

E15. A compound comprising a modified oligonucleotide having a nucleobase sequence consisting of the nucleobase sequence of any one of SEQ ID NOs: 810, 1404, 2868, 2864, 2865, 1404, 1101, 2812, 1200, or 2863.

E16. A compound comprising a modified oligonucleotide consisting of 8 to 80 linked nucleosides having a nucleobase sequence comprising any one of SEQ ID NOs: 810, 1404, 2868, 2864, 2865, 1404, 1101, 2812, 1200, or 2863.

E17. A compound comprising a modified oligonucleotide having a nucleobase sequence consisting of the nucleobase sequence of any one of SEQ ID NOs: 810, 1404, 2868, 2864, 2865, 1404, 1101, 2812, 1200, or 2863.

E18. The compound of any one of embodiments E1-E17, wherein the modified oligonucleotide comprises at least one modified internucleoside linkage, at least one modified sugar, or at least one modified nucleobase.

E19. The compound of embodiment E18, wherein the modified internucleoside linkage is a phosphorothioate internucleoside linkage.

E20. The compound of embodiment E18 or E19, wherein the modified sugar is a bicyclic sugar.

E21. The compound of embodiment E20, wherein the bicyclic sugar is selected from the group consisting of: 4'-(CH$_2$)—O-2' (LNA); 4'-(CH$_2$)$_2$—O-2' (ENA); and 4'-CH (CH$_3$)—O-2' (cEt).

E22. The compound of embodiment E18 or E19, wherein the modified sugar is 2'-O-methoxyethyl.

E23. The compound of any one of embodiments E18-E22, wherein the modified nucleobase is a 5-methylcytosine.

E24. The compound of any one of embodiments E1-E23, wherein the modified oligonucleotide comprises:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

E25. A compound comprising a modified oligonucleotide consisting of 16 to 80 linked nucleosides having a nucleobase sequence comprising any one of SEQ ID NOs: 810, 1404, 2868, 2864, 2865, 1404, 1101, 2812, 1200, or 2863, wherein the modified oligonucleotide comprises:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

E26. A compound comprising a modified oligonucleotide consisting of 16-80 linked nucleobases having a nucleobase sequence comprising the sequence recited in any one of SEQ ID NOs: 810 and 1404, wherein the modified oligonucleotide comprises:
a gap segment consisting of ten linked 2'-deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine.

E27. A compound comprising a modified oligonucleotide consisting of 16-80 linked nucleobases having a nucleobase sequence comprising the sequence recited in SEQ ID NOs: 2864, wherein the modified oligonucleotide comprises:
a gap segment consisting of ten linked 2'-deoxynucleosides;
a 5' wing segment consisting of one linked nucleoside; and
a 3' wing segment consisting of five linked nucleosides;
wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine.

E28. A compound comprising a modified oligonucleotide consisting of 16-80 linked nucleobases having a nucleobase sequence comprising the sequence recited in SEQ ID NO: 2868, wherein the modified oligonucleotide comprises a gapmer consisting of a 5'-region, a 3'-region, and a central region positioned between the 5'-region and the 3'-region wherein:
the 5'-region consists of 3 linked modified nucleosides, wherein each nucleoside of the 5'-region comprises a cEt nucleoside;
the 3'-region consists of 3 linked modified nucleosides, wherein each nucleoside of the 3'-region comprises a cEt nucleoside;
the central region consists of 10 linked nucleosides, wherein the second nucleoside from the 5' end of the central region comprises a 2'-O-methyl modified sugar moiety and the first and third through tenth nucleosides from the 5' end of the central region each comprises a 2'deoxynucleoside;
wherein each internucleoside linkage is a phosphorothioate linkage; and
wherein each cytosine is a 5-methylcytosine.

E29. A compound comprising a modified oligonucleotide consisting of 16-80 linked nucleobases having a nucleobase sequence comprising the sequence recited in SEQ ID NOs: 1200 or 2863, wherein the modified oligonucleotide comprises:
a gap segment consisting of nine linked 2'-deoxynucleosides;
a 5' wing segment consisting of two linked nucleosides; and
a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine.

E30. A compound comprising or consisting of a modified oligonucleotide consisting of 16-80 linked nucleobases having a nucleobase sequence comprising the sequence recited in SEQ ID NO: 2865, wherein the modified oligonucleotide comprises:
a gap segment consisting of ten linked 2'-deoxynucleosides;
a 5' wing segment consisting of one linked nucleoside; and
a 3' wing segment consisting of five linked nucleosides;
wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine.

E31. The compound of any one of embodiments E1-E30, wherein the oligonucleotide is at least 80%, 85%, 90%, 95% or 100% complementary to any of SEQ ID NOs: 1-10.

E32. The compound of any one of embodiments E1-E31, wherein the compound is single-stranded.

E33. The compound of any one of embodiments E1-E31, wherein the compound is double-stranded.

E34. The compound of any one of embodiments E1-E33, wherein the compound comprises ribonucleotides.

E35. The compound of any one of embodiments E1-E33, wherein the compound comprises deoxyribonucleotides.

E36. The compound of any one of embodiments E1-E35, wherein the modified oligonucleotide consists of 16 to 30 linked nucleosides.

E37. The compound of any preceding embodiment E1-E36, wherein the compound consists of the modified oligonucleotide.

E38. A compound consisting of a pharmaceutically acceptable salt of any of the compounds of embodiments E1-E36.

E39. The compound of embodiment E38, wherein the pharmaceutically acceptable salt is a sodium salt.

E40. The compound of embodiment E38, wherein the pharmaceutically acceptable salt is a potassium salt.

E41. A compound having the formula:

(SEQ ID NO: 2865)

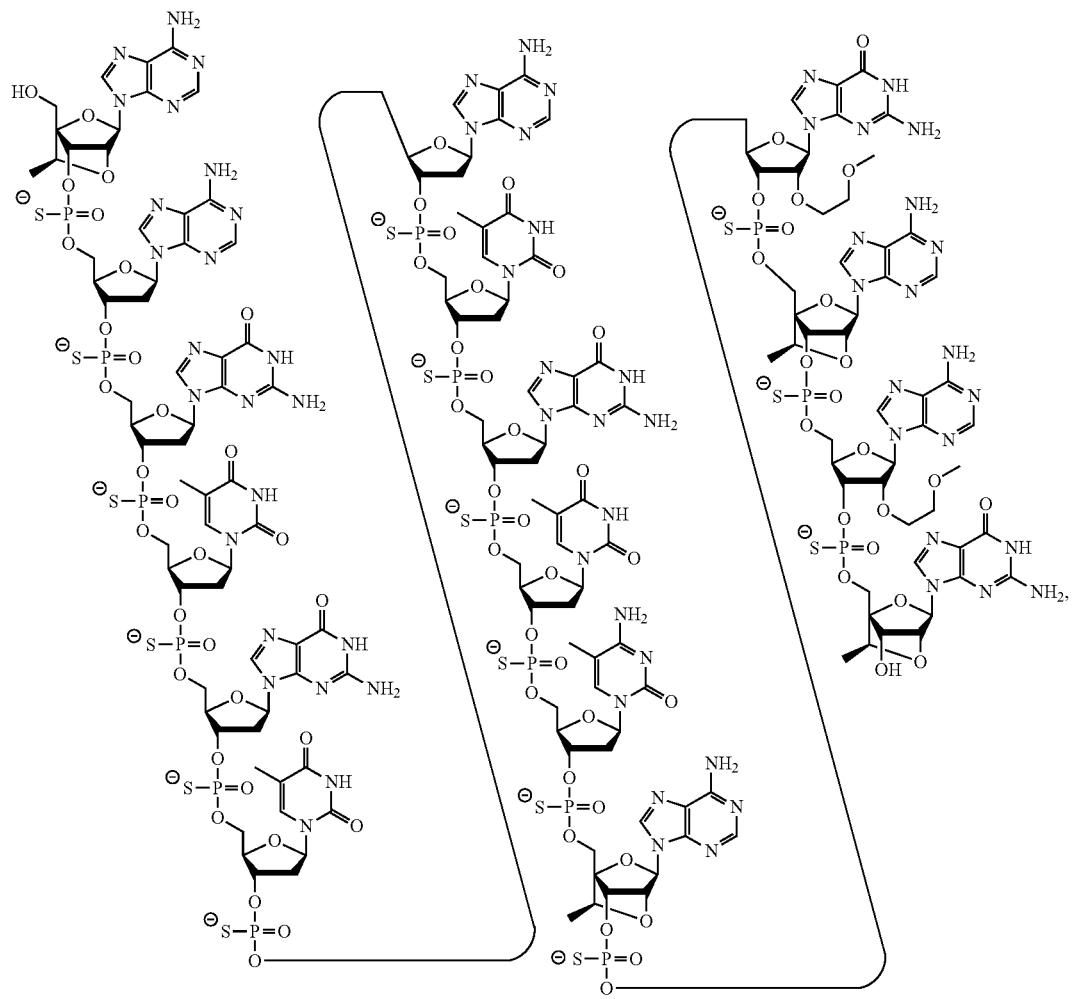

or a salt thereof.

E42. A compound having the formula:

(SEQ ID NO: 2865)

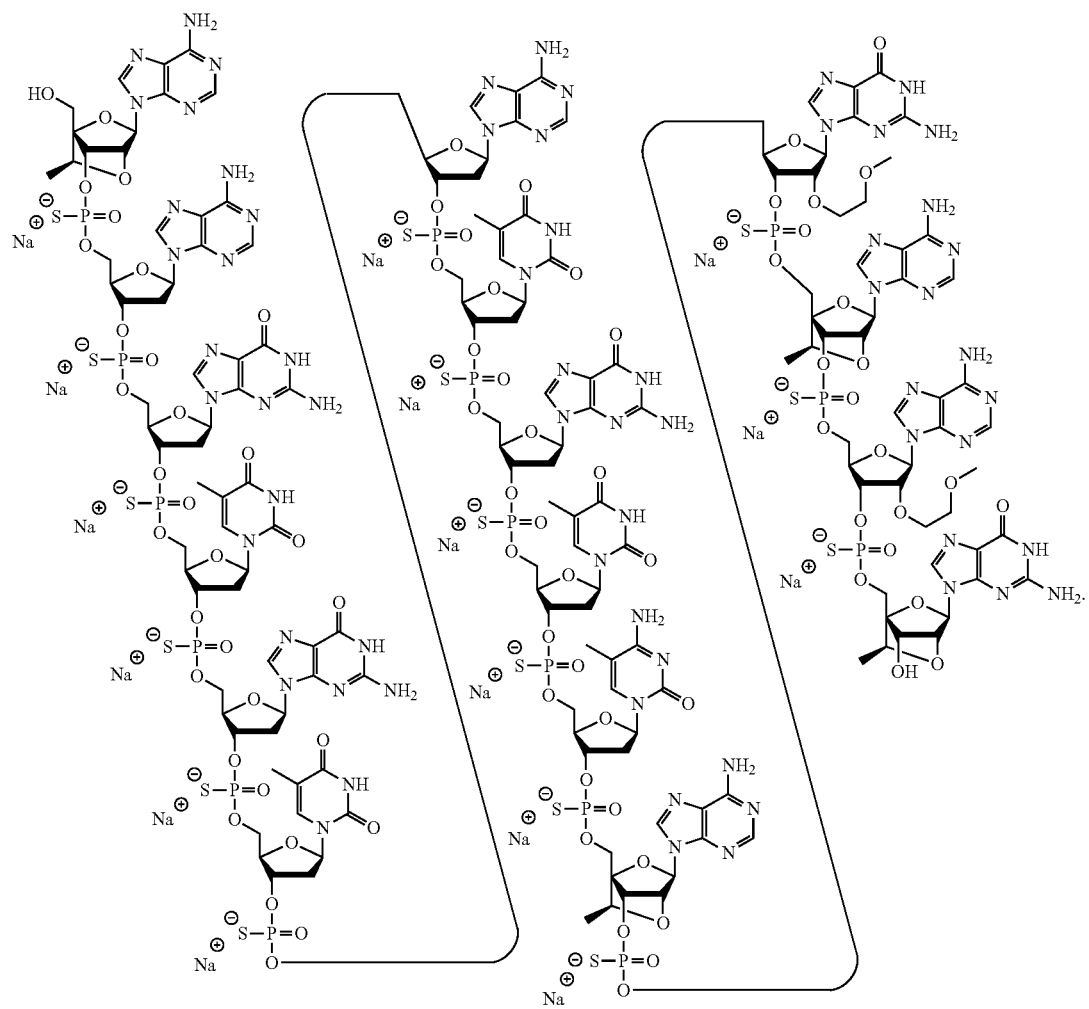

E43. A composition comprising the compound of any one of embodiments E1-E42 and a pharmaceutically acceptable diluent or carrier.

E44. A composition comprising the compound of any one of embodiments E1-E42 and water.

E45. A composition comprising a compound or modified oligonucleotide of any preceding embodiment E1-E44, for use in therapy.

E46. A combination comprising the compound of any one of embodiments E1-E42 or the composition of any of embodiments E43-E45 and a secondary agent.

E47. The combination of embodiment E46, wherein the secondary agent is a CDK4/6 inhibitor.

E48. The combination of embodiment E47, wherein the CDK4/6 inhibitor is palbociclib, ribociclib, or abemaciclib.

E49. The combination of embodiment E46, wherein the secondary agent is an EGFR inhibitor.

E50. The combination of embodiment E49, wherein the EGFR inhibitor is cetuximab, necitumumab, panitumumab, vandetanib, dacomitinib, neratinib, osimertinib, gefitinib, lapatinib, or erlotinib.

E51. The combination of embodiment E46, wherein the secondary agent is a kinase inhibitor.

E52. The combination of embodiment E51, wherein the kinase inhibitor is sorafenib, regorafenib, or carbozantinib.

E53. A method of treating or ameliorating cancer in an individual comprising administering to the individual a compound targeted to YAP1, thereby treating or ameliorating the cancer.

E54. The method of embodiment E53, wherein the compound is an antisense compound targeted to YAP1.

E55. The method of embodiment E53 or E54, further comprising administering a secondary agent.

E56. The method of embodiment E55, wherein the secondary agent is a CDK4/6 inhibitor.

E57. The method of embodiment E56, wherein the CDK4/6 inhibitor is palbociclib, ribociclib, or abemaciclib.

E58. The method of embodiment E55, wherein the secondary agent is an EGFR inhibitor.

E59. The method of embodiment E58, wherein the EGFR inhibitor is cetuximab, necitumumab, panitumumab, vandetanib, dacomitinib, neratinib, osimertinib, gefitinib, lapatinib, or erlotinib.

E60. The method of embodiment E55, wherein the secondary agent is a kinase inhibitor.

E61. The method of embodiment E60, wherein the kinase inhibitor is sorafenib, regorafenib, or carbozantinib.

E62. The method of any of embodiments E53-E61, wherein the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E63. The method of any of embodiments E53-E62, wherein administering the compound inhibits or reduces cancer cell proliferation, tumor growth, or metastasis.

E64. A method of inhibiting expression of YAP1 in a cell comprising contacting the cell with a compound targeted to YAP1, thereby inhibiting expression of YAP1 in the cell.

E65. The method of embodiment E64, wherein the cell a cancer cell.

E66. The method of embodiment E65, wherein the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E67. A method of reducing or inhibiting cancer cell proliferation, tumor growth, or metastasis in an individual having cancer comprising administering a compound targeted to YAP1 to the individual, thereby reducing or inhibiting cancer cell proliferation, tumor growth, or metastasis in the individual.

E68. The method of embodiment E67, wherein the individual has hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E69. The method of any one of embodiments E64-E68, wherein the compound is an antisense compound targeted to YAP1.

E70. The method of any one of embodiments E64-E69, wherein the compound is the compound of any one of embodiments 1-42 or composition of any one of embodiments 43-45.

E71. The method of any of embodiments E64-E70, wherein the compound is administered parenterally.

E72. Use of a compound targeted to YAP1 for treating, preventing, or ameliorating a cancer associated with YAP1.

E73. Use of a compound targeted to YAP1 and a secondary agent for treating, preventing, or ameliorating a cancer associated with YAP1.

E74. The use of embodiment E73, wherein the secondary agent is a CDK4/6 inhibitor.

E75. The use of embodiment E74, wherein the CDK4/6 inhibitor is palbociclib, ribociclib, or abemaciclib.

E76. The use of embodiment E73, wherein the secondary agent is an EGFR inhibitor.

E77. The use of embodiment E76, wherein the EGFR inhibitor is cetuximab, necitumumab, panitumumab, vandetanib, dacomitinib, neratinib, osimertinib, gefitinib, lapatinib, or erlotinib.

E78. The use of embodiment E73, wherein the secondary agent is a kinase inhibitor.

E79. The use of embodiment E78, wherein the kinase inhibitor is sorafenib, regorafenib, or carbozantinib.

E80. The use of any of embodiments E72-E79, wherein the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E81. The use of any of embodiments E72-E80, wherein the compound is an antisense compound targeted to YAP1.

E82. The use of any of embodiments E72-E81, wherein the compound is the compound of any one of embodiments E1-E42 or composition of any one of embodiments E43-E45.

E83. Use of a compound targeted to YAP1 in the manufacture of a medicament for treating or ameliorating a cancer associated with YAP1.

E84. The use of embodiment E83, wherein the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E85. The use of embodiment E83 or E84, wherein the compound is an antisense compound targeted to YAP1.

E86. The use of any one of embodiments E83-E85, wherein the compound is the compound of any one of embodiments 1-42 or composition of any one of embodiments E43-E45.

E87. Use of a compound targeted to YAP1 in the preparation of a medicament for treating or ameliorating a cancer associated with YAP1.

E88. The use of embodiment E87, wherein the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL), a cancer having a mutant FAT1 gene, a cancer having a homozygous FAT1 gene mutation, or a cancer having a heterozygous FAT1 gene mutation, a squamous cell carcinoma (SCC) having a mutant FAT1 gene, a head and neck squamous cell carcinoma (HNSCC) having a mutant FAT1 gene, an oral tongue squamous cell carcinoma (OTSCC) having a mutant FAT1 gene, a pharynx carcinoma having a mutant FAT1 gene, or a laryngeal squamous cell carcinoma having a mutant FAT1 gene.

E89. The use of embodiment E87 or E88, wherein the compound is an antisense compound targeted to YAP1.

E90. The use of any one of embodiments E87-E89, wherein the compound is the compound of any one of embodiments 1-42 or composition of any one of embodiments E43-E45.

Certain Indications

Certain embodiments provided herein relate to methods of inhibiting YAP1 expression, which can be useful for treating, preventing, or ameliorating a cancer associated with YAP1 in an individual, by administration of a compound that targets YAP1. In certain embodiments, the compound can be a YAP1 specific inhibitor. In certain embodiments, the compound can be an antisense compound, oligomeric compound, or oligonucleotide targeted to YAP1.

Examples of cancers associated with YAP1 treatable, preventable, and/or ameliorable with the compounds and methods provided herein include hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma.

In certain embodiments, a method of treating, preventing, or ameliorating a cancer associated with YAP1 in an individual comprises administering to the individual a compound comprising a YAP1 specific inhibitor, thereby treating, preventing, or ameliorating the cancer. In certain embodiments, the compound comprises an antisense compound targeted to YAP1. In certain embodiments, the compound comprises an oligonucleotide targeted to YAP1. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, a compound comprises a modified oligonucleotide consisting of 16 to 80 linked nucleosides and having a nucleobase sequence comprising the nucleobase sequence of any one of SEQ ID NOs: 23-2940. In certain embodiments, a compound comprises a modified oligonucleotide having a nucleobase sequence consisting of the nucleobase sequence of any one of SEQ ID NOs: 23-2940. In certain embodiments, a compound comprises a modified oligonucleotide consisting of 16 to 80 linked nucleosides and having a nucleobase sequence comprising any one of SEQ ID NOs: 810, 1404, 2868, 2864, 2865, 1404, 1101, 2812, 1200, or 2863. In certain embodiments, a compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis.

In certain embodiments, a method of treating or ameliorating caner comprises administering to the individual a compound comprising a YAP1 specific inhibitor, thereby treating or ameliorating the cancer. In certain embodiments, the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis. In certain embodiments, the individual is identified as having or at risk of having a cancer associated with YAP1.

In certain embodiments, a method of inhibiting expression of YAP1 in an individual having, or at risk of having, a cancer associated with YAP1 comprises administering to the individual a compound comprising a YAP1 specific inhibitor, thereby inhibiting expression of YAP1 in the individual. In certain embodiments, administering the compound inhibits expression of YAP1 in a cancer cell in the individual. In certain embodiments, the individual has, or is at risk of having hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis. In certain embodiments, the individual is identified as having or at risk of having a cancer associated with YAP1.

In certain embodiments, a method of inhibiting expression of YAP1 in a cell comprises contacting the cell with a compound comprising a YAP1 specific inhibitor, thereby inhibiting expression of YAP1 in the cell. In certain embodiments, the cell is a cancer cell. In certain embodiments, the cell is a liver cancer cell or squamous cancer cell. In certain embodiments, the cancer cell is in the liver, head, or neck of an individual having cancer. In certain embodiments, the cell is in an individual who has, or is at risk of having cancer, such as hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound.

In certain embodiments, a method of reducing or inhibiting cancer cell proliferation, tumor growth, or metastasis of an individual having, or at risk of having, a cancer associated with YAP1 comprises administering to the individual a compound comprising a YAP1 specific inhibitor, thereby reducing or inhibiting cancer cell proliferation, tumor growth, or metastasis in the individual. In certain embodiments, the individual has, or is at risk of having, hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a cancer associated with YAP1.

Certain embodiments are drawn to a compound comprising a YAP1 specific inhibitor for use in treating cancer. In certain embodiments, the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs:

23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound.

Certain embodiments are drawn to a compound comprising a YAP1 specific inhibitor for use in reducing or inhibiting cancer cell proliferation, tumor growth, or metastasis in an individual having cancer. In certain embodiments, the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound.

Certain embodiments are drawn to use of a compound comprising a YAP1 specific inhibitor for the manufacture or preparation of a medicament for treating cancer. Certain embodiments are drawn to use of a compound comprising a YAP1 specific inhibitor for the preparation of a medicament for treating a cancer associated with YAP1. In certain embodiments, the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs:

23-2940. In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound.

Certain embodiments are drawn to use of a compound comprising a YAP1 specific inhibitor for the manufacture or preparation of a medicament for reducing or inhibiting cancer cell proliferation, tumor growth, or metastasis in an individual having cancer. In certain embodiments, the cancer is hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, the compound comprises an antisense compound targeted to YAP1. In certain embodiments, the compound comprises an oligonucleotide targeted to YAP1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 23-2940. In certain embodiments, the compound comprises a modified oligonucleotide consisting of 16 to 80 linked nucleosides and having a nucleobase sequence comprising the nucleobase sequence of any one of SEQ ID NOs: 23-2940. In certain embodiments, the compound comprises a modified oligonucleotide having a nucleobase sequence consisting of the nucleobase sequence of any one of SEQ ID NOs: 23-2940.

In certain embodiments, the compound comprises a modified oligonucleotide consisting of 16 to 80 linked nucleosides and having a nucleobase sequence comprising the nucleobase sequence of any one of SEQ ID NOs: 810, 1404, 2868, 2864, 2865, 1404, 1101, 2812, 1200, or 2863. In certain embodiments, the compound comprises a modified oligonucleotide having a nucleobase sequence consisting of the nucleobase sequence of any one of SEQ ID NOs: 810, 1404, 2868, 2864, 2865, 1404, 1101, 2812, 1200, or 2863. In any of the foregoing embodiments, the modified oligonucleotide can consist of 10 to 30 linked nucleosides. In certain embodiments, the compound is ION 958499, 1076453, 1197270, 1198439, 1198440, 1198605, 1198623, 1198728, 1198831, or 1198872. In any of the foregoing embodiments, the compound can be single-stranded or double-stranded. In any of the foregoing embodiments, the compound can be an antisense compound or oligomeric compound.

In any of the foregoing methods or uses, the compound can be targeted to YAP1. In certain embodiments, the compound comprises or consists of a modified oligonucleotide, for example a modified oligonucleotide consisting of 8 to 80 linked nucleosides, 10 to 30 linked nucleosides, 12 to 30 linked nucleosides, or 20 linked nucleosides. In certain embodiments, the modified oligonucleotide is at least 80%, 85%, 90%, 95% or 100% complementary to any of the nucleobase sequences recited in SEQ ID NOs: 1-10. In certain embodiments, at least one internucleoside linkage of the modified oligonucleotide is a modified internucleoside linkage, at least one nucleoside of the modified oligonucleotide comprises a modified sugar and/or at least one nucleobase of the modified oligonucleotide is a modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide has a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide can consist of 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides. In certain embodiments, the modified oligonucleotide is at least 80%, 85%, 90%, 95% or 100% complementary to any of the nucleobase sequences recited in SEQ ID NOs: 1-10. In certain embodiments, at least one internucleoside linkage of the modified oligonucleotide is a modified internucleoside linkage, at least one nucleoside of the modified oligonucleotide comprises a modified sugar and/or at least one nucleobase of the modified oligonucleotide is a modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide has a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound can comprise or consist of a modified oligonucleotide consisting of 16 to 80 linked nucleosides and having a nucleobase sequence comprising the nucleobase sequence of any one of SEQ ID NOs: 23-2940, wherein the modified oligonucleotide has:

a gap segment consisting of linked 2'-deoxynucleosides;
a 5' wing segment consisting of linked nucleosides; and
a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 810, 1404, 2868, 2864, 2865, 1404, 1101, 2812, 1200, or 2863, wherein the modified oligonucleotide has:

a gap segment consisting of linked 2'-deoxynucleosides;
a 5' wing segment consisting of linked nucleosides; and
a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 810 and 1404, wherein the modified oligonucleotide has:

a gap segment consisting of ten linked 2'-deoxynucleosides;
a 5' wing segment consisting of three linked nucleosides; and
a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the sequence recited in SEQ ID NO: 2864, wherein the modified oligonucleotide has:

a gap segment consisting of ten linked 2'-deoxynucleosides;
a 5' wing segment consisting of one linked nucleoside; and
a 3' wing segment consisting of five linked nucleosides;

wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in SEQ ID NOs: 1200 or 2863, wherein the modified oligonucleotide has:

a gap segment consisting of nine linked 2'-deoxynucleosides;
a 5' wing segment consisting of two linked nucleosides; and
a 3' wing segment consisting of five linked nucleosides;

wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in SEQ ID NO: 2865, wherein the modified oligonucleotide has:

a gap segment consisting of ten linked 2'-deoxynucleosides;
a 5' wing segment consisting of one linked nucleoside; and
a 3' wing segment consisting of five linked nucleosides;

wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can be a modified oligonucleotide, wherein the anion form of the modified oligonucleotide has the following chemical structure:
(SEQ ID NO: 2865)
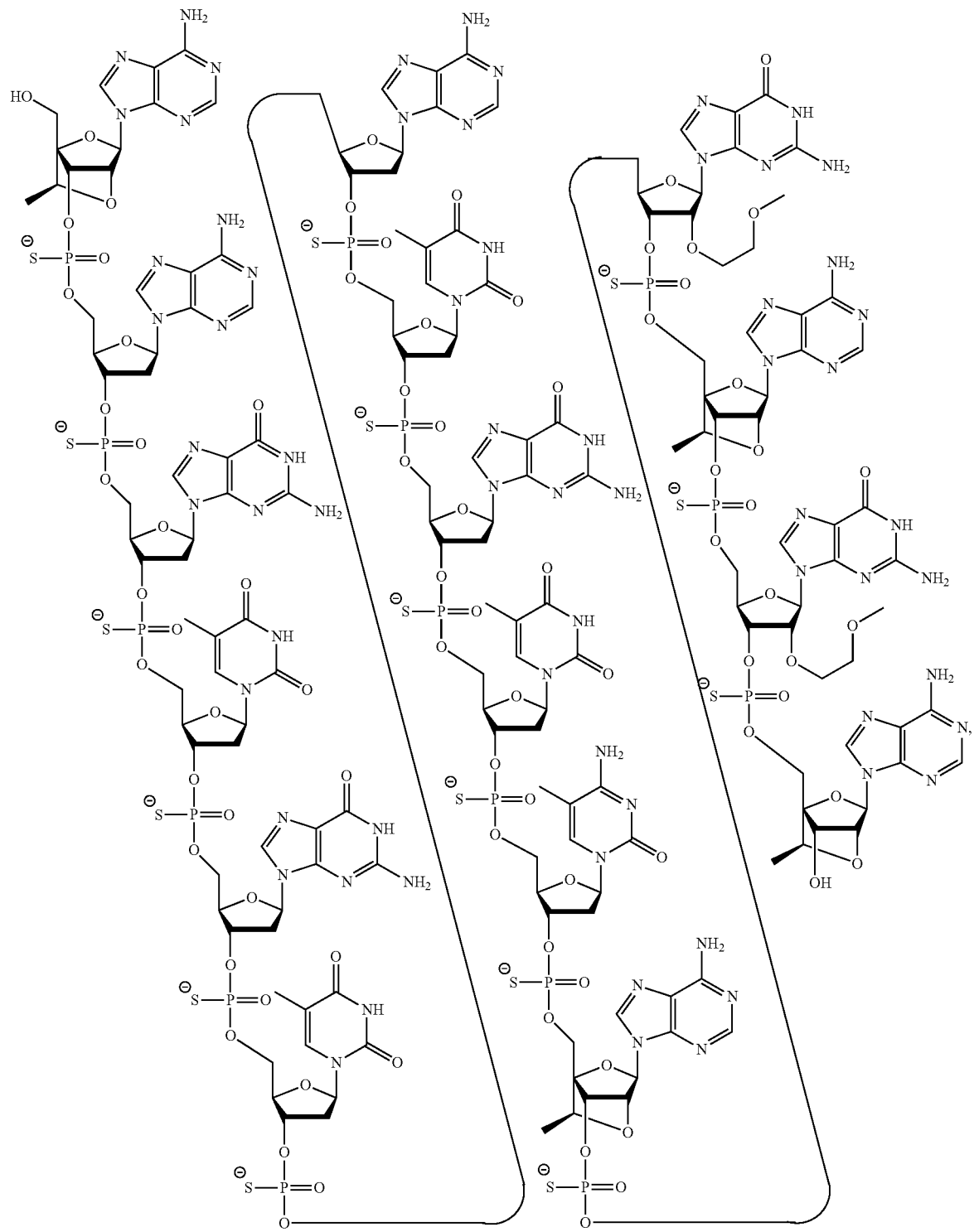
or a salt thereof.

In any of the foregoing methods or uses, the compound can be a modified oligonucleotide according to the following chemical structure:
(SEQ ID NO: 2865)
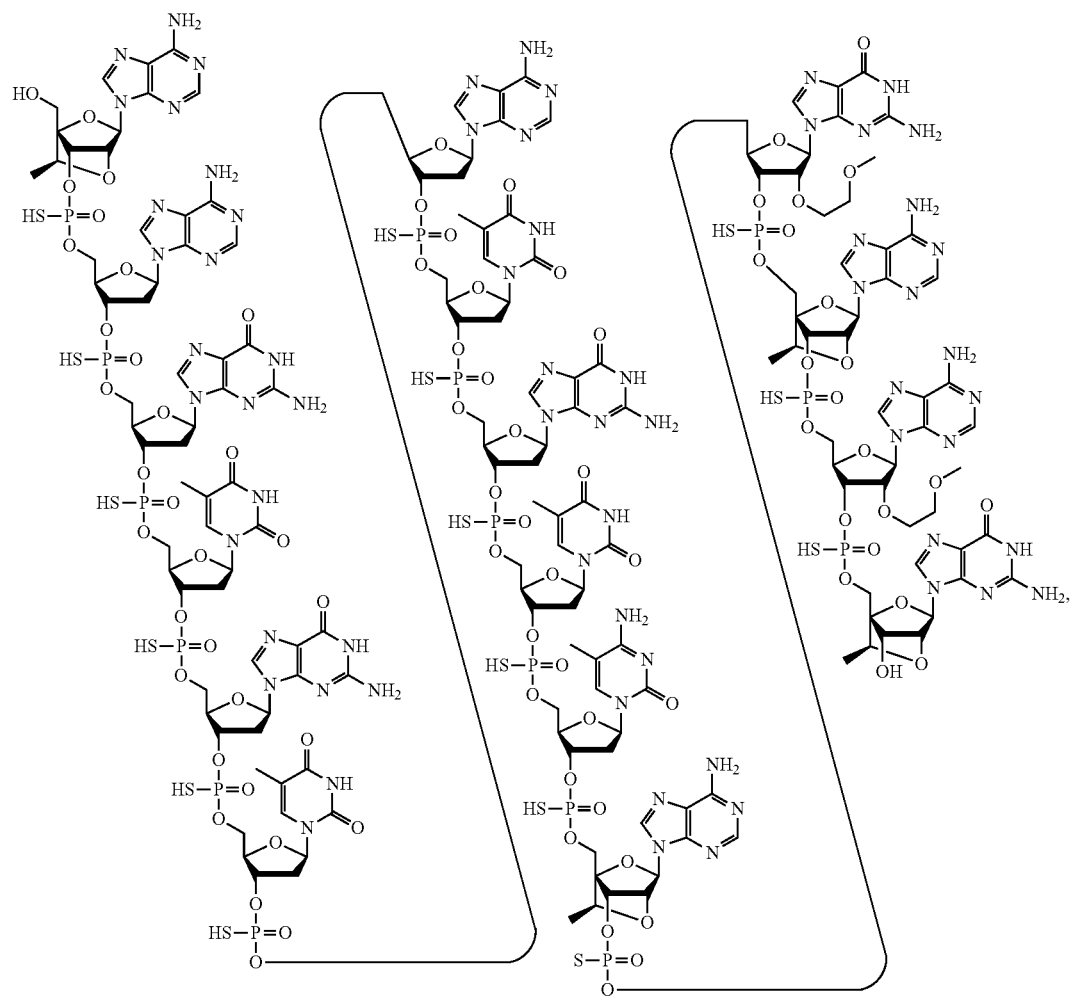
or a salt thereof.

In any of the foregoing methods or uses, the compound can be a modified oligonucleotide according to the following chemical structure:

agent. In certain embodiments, such second agents are designed to treat an undesired side effect of one or more pharmaceutical compositions as described herein. In certain (SEQ ID NO: 2865)

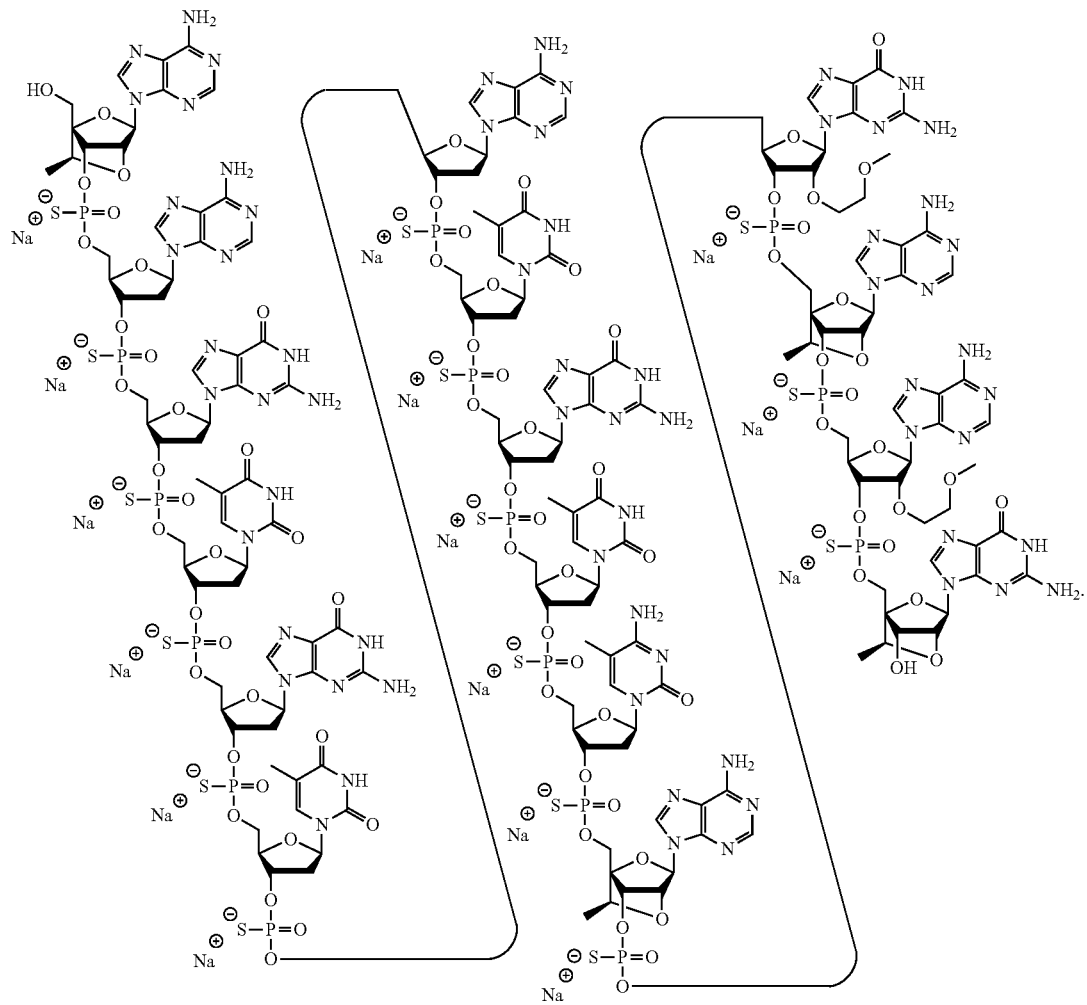

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Combinations and Combination Therapies

In certain embodiments, a first agent comprising a compound described herein is co-administered with one or more secondary agents. In certain embodiments, such second agents are designed to treat the same disease, disorder, or condition as the first agent described herein. In certain embodiments, such second agents are designed to treat a different disease, disorder, or condition as the first agent described herein. In certain embodiments, a first agent is designed to treat an undesired side effect of a second agent. In certain embodiments, second agents are co-administered with the first agent to treat an undesired effect of the first embodiments, second agents are co-administered with the first agent to produce a combinational effect. In certain embodiments, second agents are co-administered with the first agent to produce a synergistic effect. In certain embodiments, the co-administration of the first and second agents permits use of lower dosages than would be required to achieve a therapeutic or prophylactic effect if the agents were administered as independent therapy.

In certain embodiments, one or more compounds or compositions provided herein, such as ION 1198440, are co-administered with one or more secondary agents. In certain embodiments, one or more compounds or compositions provided herein and one or more secondary agents, are administered at different times. In certain embodiments, one or more compounds or compositions provided herein and one or more secondary agents, are prepared together in a single formulation. In certain embodiments, one or more compounds or compositions provided herein and one or more secondary agents, are prepared separately. In certain embodiments, a secondary agent is selected from: CDK4/6 inhibitors including but not limited to palbociclib, ribociclib, or abemaciclib; EGFR inhibitors including but not limited to cetuximab, necitumumab, panitumumab, vandetanib, dacomitinib, neratinib, osimertinib, gefitinib, lapatinib, or erlotinib; or kinase inhibitors including but not limited to sorafenib, regorafenib, or carbozantinib.

Certain embodiments are directed to the use of a compound targeted to YAP1 as described herein, such as ION 1198440, in combination with a secondary agent. In particular embodiments such use is in a method of treating a patient suffering from cancer including, but not limited to, hepatocellular carcinoma (HCC), head and neck squamous cell carcinoma (HNSCC), head and neck cancer, pharynx carcinoma, laryngeal squamous cell carcinoma, oral tongue squamous cell carcinoma (OTSCC), squamous cell carcinoma (SCC), sarcomas (e.g. epitheloid, rhabdoid and synovial), esophageal cancer, gastric cancer, ovarian cancer, pancreatic cancer, tumors with mutations in SWI/SNF complex, lung cancer, non-small cell lung carcinoma (NSCLC), small-cell lung carcinoma (SCLC), gastrointestinal cancer, large intestinal cancer, small intestinal cancer, stomach cancer, colon cancer, colorectal cancer, bladder cancer, liver cancer, biliary tract cancer, urothelial cancer, breast cancer, triple-negative breast cancer (TNBC), endometrial cancer, cervical cancer, prostate cancer, mesothelioma, chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the cancer has a mutant FAT1 gene. In certain embodiments, the cancer has a homozygous or heterozygous FAT1 gene mutation. In certain embodiments, the cancer having a mutant FAT1 gene, a homozygous FAT1 gene mutation, or a heterozygous FAT gene mutation is squamous cell carcinoma (SCC), head and neck squamous cell carcinoma (HNSCC), oral tongue squamous cell carcinoma (OTSCC), pharynx carcinoma, or laryngeal squamous cell carcinoma. In certain embodiments, a secondary agent is selected from: CDK4/6 inhibitors including but not limited to palbociclib, ribociclib, or abemaciclib; EGFR inhibitors including but not limited to cetuximab, necitumumab, panitumumab, vandetanib, dacomitinib, neratinib, osimertinib, gefitinib, lapatinib, or erlotinib; or kinase inhibitors including but not limited to sorafenib, regorafenib, or carbozantinib.

Certain embodiments are drawn to a combination of a compound targeted to YAP1 as described herein, such as ION 1198440, and a secondary agent, such as CDK4/6 inhibitors including but not limited to palbociclib, ribociclib, or abemaciclib; EGFR inhibitors including but not limited to cetuximab, necitumumab, panitumumab, vandetanib, dacomitinib, neratinib, osimertinib, gefitinib, lapatinib, or erlotinib; or kinase inhibitors including but not limited to sorafenib, regorafenib, or carbozantinib.

In certain embodiments the compound targeted to YAP1 as described herein, such as ION 1198440, and the secondary agent are used in combination treatment by administering the two agents simultaneously, separately or sequentially. In certain embodiments the two agents are formulated as a fixed dose combination product. In other embodiments the two agents are provided to the patient as separate units which can then either be taken simultaneously or serially (sequentially).

In certain embodiments, a compound targeted to YAP1 as described herein, such as ION 1198440, is used in combination with an immunomodulatory agent such as an anti-PD-L1 antibody (or an antigen-binding fragment thereof), an anti-PD-1 antibody (or an antigen-binding fragment thereof), an anti-CTLA-4 antibody (or an antigen-binding fragment thereof) or an OX40 agonist ((e.g., an OX40 ligand fusion protein, or an OX40 agonist antibody or antigen-binding fragment thereof).

In certain embodiments, a compound targeted to YAP1 as described herein, such as ION 1198440, is used in combination with an immune checkpoint inhibitor such as an anti-PD-L1 antibody (or an antigen-binding fragment thereof), an anti-PD-1 antibody (or an antigen-binding fragment thereof), or an anti-CTLA-4 antibody (or an antigen-binding fragment thereof).

Anti-PD-L1 antibodies are known in the art. Exemplary anti-PD-L1 antibodies include: MEDI4736 (durvalumab), MPDL3280A, BMS936559, 2.7A4, AMP-714, MDX-1105 and MPDL3280A (atezolizumab).

Anti-PD-1 antibodies are known in the art. Exemplary anti-PD-1 antibodies include: nivolumab, pembrolizumab, pidilizumab, and AMP-514

Anti-CTLA-4 antibodies are known in the art. Exemplary anti-CTLA-4 antibodies include: tremelimumab and ipilimumab, also termed MDX-010 (or BMS-734016).

OX40 agonists and antibodies are known in the art. Exemplary OX40 agonists and/or antibodies include: MEDI6383, 9B12 and MEDI0562.

In one embodiment, the combination includes the antisense oligonucleotide Ionis 1198440 or a salt thereof, and at least one immunomodulator selected from the group consisting of: MEDI4736, MPDL3280A, BMS936559, 2.7A4, AMP-714, MDX-1105, nivolumab, pembrolizumab, pidilizumab, MPDL3280A, tremelimumab, ipilimumab, MEDI0562 and MEDI0562.

In one embodiment, the combination includes the anti-PD-L1 antibody MEDI4736 (duvalumab) and ION 1198440.

In one embodiment, the combination includes ION 1198440, the anti-PD-L1 antibody MEDI4736 (durvalumab) and the anti-CTLA-4 antibody tremelimumab.

Certain Anti-PD-L1 Antibodies

Antibodies that specifically bind and inhibit PD-L1 are included in the present disclosure.

Durvalumab (MEDI4736) is an exemplary anti-PD-L1 antibody that is selective for a PD-L1 polypeptide and blocks the binding of PD-L1 to the PD-1 and CD80 receptors. Durvalumab can relieve PD-L1-mediated suppression of human T-cell activation in vitro and inhibits tumor growth in a xenograft model via a T-cell dependent mechanism.

Information regarding durvalumab (or fragments thereof) for use in the methods provided herein can be found in U.S. Pat. No. 8,779,108, the disclosure of which is incorporated herein by reference in its entirety. The fragment crystallizable (Fc) domain of durvalumab contains a triple mutation in the constant domain of the IgG1 heavy chain that reduces binding to the complement component C1q and the Fcγ receptors responsible for mediating antibody-dependent cell-mediated cytotoxicity (ADCC).

Durvalumab and antigen-binding fragments thereof for use in the methods provided herein comprises a heavy chain and a light chain or a heavy chain variable region and a light chain variable region. In certain embodiments, MEDI4736 or an antigen-binding fragment thereof for use in the methods provided herein comprises the variable heavy chain and variable light chain CDR sequences of the 2.14H9OPT antibody as disclosed in U.S. Pat. Nos. 8,779,108 and 9,493,565, which is herein incorporated by reference in its entirety.

There are numerous anti-PD-L1 antibodies in the published literature that could feature in the present disclosure, including compounds in development and/or in clinical trials such as: durvalumab (MEDI4736), MPDL3280A, BMS936559, 2.7A4, AMP-714 and MDX-1105. Patent specifications disclosing anti-PD-L1 antibodies that may be useful in the present disclosure include: U.S. Pat. Nos. 7,943,743; 8,383,796; 9,102,725; 9,273,135 (BMS/Medarex), US2006/0153841 (Dana Farber), US2011/0271358 (Dana Farber), U.S. Pat. Nos. 8,552,154 and 9,102,727 (Dana Farber), U.S. Pat. No. 8,217,149 (Genentech), including issued U.S. Pat. No. 8,217,149, US2012/0039906 (INSERM), US2016/0031990 (Amplimmune), U.S. Pat. No. 8,779,108 (MedImmune—for durvalumab/MEDI4726 and 2.7A4), US2014/0044738 (Amplimmune—for AMP-714) and US2010/0285039 (John's Hopkins University). Each of these disclosures is herein incorporated by reference in its entirety.

Certain Anti-CTLA-4 Antibodies

Antibodies that specifically bind CTLA-4 and inhibit CTLA-4 activity are useful for enhancing an anti-tumor immune response. Information regarding tremelimumab (or antigen-binding fragments thereof) for use in the methods provided herein can be found in U.S. Pat. No. 6,682,736 (where it is referred to as 11.2.1), the disclosure of which is incorporated herein by reference in its entirety. Tremelimumab (also known as CP-675,206, CP-675, CP-675206, and ticilimumab) is a human IgG2 monoclonal antibody that is highly selective for CTLA-4 and blocks binding of CTLA-4 to CD80 (B7.1) and CD86 (B7.2). It has been shown to result in immune activation in vitro and some patients treated with tremelimumab have shown tumor regression.

Tremelimumab for use in the methods provided herein comprises a heavy chain and a light chain or a heavy chain variable region and a light chain variable region. In a specific aspect, tremelimumab or an antigen-binding fragment thereof for use in the methods provided herein comprises a light chain variable region comprising the amino acid sequences shown herein above and a heavy chain variable region comprising the amino acid sequence shown herein above. In a specific aspect, tremelimumab or an antigen-binding fragment thereof for use in the methods provided herein comprises a heavy chain variable region and a light chain variable region, wherein the heavy chain variable region comprises the Kabat-defined CDR1, CDR2, and CDR3 sequences shown herein above, and wherein the light chain variable region comprises the Kabat-defined CDR1, CDR2, and CDR3 sequences shown herein above. Those of ordinary skill in the art would easily be able to identify Chothia-defined, Abm-defined or other CDR definitions known to those of ordinary skill in the art. In a specific aspect, tremelimumab or an antigen-binding fragment thereof for use in the methods provided herein comprises the variable heavy chain and variable light chain CDR sequences of the 11.2.1 antibody as disclosed in U.S. Pat. No. 6,682,736, which is herein incorporated by reference in its entirety.

Other anti-CTLA-4 antibodies are described, for example, in US 20070243184. In one embodiment, the anti-CTLA-4 antibody is Ipilimumab, also termed MDX-010; BMS-734016.

Certain OX40 Agonists

OX40 agonists interact with the OX40 receptor on CD4+ T-cells during, or shortly after, priming by an antigen resulting in an increased response of the CD4+ T-cells to the antigen. An OX40 agonist interacting with the OX40 receptor on antigen specific CD4+ T-cells can increase T cell proliferation as compared to the response to antigen alone. The elevated response to the antigen can be maintained for a period of time substantially longer than in the absence of an OX40 agonist. Thus, stimulation via an OX40 agonist enhances the antigen specific immune response by boosting T-cell recognition of antigens, e.g., tumor cells. OX40 agonists are described, for example, in U.S. Pat. Nos. 6,312,700, 7,504,101, 7,622,444, and 7,959,925, which are incorporated herein by reference in their entireties. Methods of using such agonists in cancer treatment are described, for example, in US2015/0098942 and in US2015/0157710, each of which are incorporated herein by reference in its entirety.

OX40 agonists include, but are not limited to OX40 binding molecules, e.g., binding polypeptides, e.g., OX40 ligand ("OX40L") or an OX40-binding fragment, variant, or derivative thereof, such as soluble extracellular ligand domains and OX40L fusion proteins, and anti-OX40 antibodies (for example, monoclonal antibodies such as humanized monoclonal antibodies), or an antigen-binding fragment, variant or derivative thereof. Examples of anti-OX40 monoclonal antibodies are described, for example, in U.S. Pat. Nos. 5,821,332 and 6,156,878, the disclosures of which are incorporated herein by reference in their entireties. In certain embodiments, the anti-OX40 monoclonal antibody is 9B12, or an antigen-binding fragment, variant, or derivative thereof, as described in Weinberg, A. D., et al. J Immunother 29, 575-585 (2006), which is incorporated herein by reference in its entirety. In another embodiment, an OX40 antibody is MEDI0562 as described in US 2016/0137740.

In certain embodiments, the antibody which specifically binds to OX40, or an antigen-binding fragment thereof binds to the same OX40 epitope as mAb 9B12. An example of a humanized OX40 antibody is described by Morris et al., Mol Immunol. May 2007; 44(12): 3112-3121. 9B12 is a murine IgG1, anti-OX40 mAb directed against the extracellular domain of human OX40 (CD134) (Weinberg, A. D., et al. J Immunother 29, 575-585 (2006)). It was selected from a panel of anti-OX40 monoclonal antibodies because of its ability to elicit an agonist response for OX40 signaling, stability, and for its high level of production by the hybridoma. For use in clinical applications, 9B12 mAb is equilibrated with phosphate buffered saline, pH 7.0, and its concentration is adjusted to 5.0 mg/ml by diafiltration.

"OX40 ligand" ("OX40L") (also variously termed tumor necrosis factor ligand superfamily member 4, gp34, TAX transcriptionally-activated glycoprotein-1, and CD252) is found largely on antigen presenting cells (APCs), and can be induced on activated B cells, dendritic cells (DCs), Langerhans cells, plamacytoid DCs, and macrophages (Croft, M., (2010) Ann Rev Immunol 28:57-78). Other cells, including activated T cells, NK cells, mast cells, endothelial cells, and smooth muscle cells can express OX40L in response to inflammatory cytokines (Id.). OX40L specifically binds to the OX40 receptor. The human protein is described in U.S. Pat. No. 6,156,878. The mouse OX40L is described in U.S. Pat. No. 5,457,035. OX40L is expressed on the surface of cells and includes an intracellular, a transmembrane and an extracellular receptor-binding domain. A functionally active soluble form of OX40L can be produced by deleting the intracellular and transmembrane domains as described, e.g., in U.S. Pat. Nos. 5,457,035; 6,312,700; 6,156,878; 6,242,566; 6,528,055; 6,528,623; 7,098,184; and 7,125,670, the disclosures of which are incorporated herein for all purposes. A functionally active form of OX40L is a form that retains the capacity to bind specifically to OX40, that is, that possesses an OX40 "receptor binding domain." An example is amino acids 51 to 183 of human OX40L. Methods of determining the ability of an OX40L molecule or derivative to bind specifically to OX40 are discussed below. Methods of making and using OX40L and its derivatives (such as derivatives that include an OX40 binding domain) are described in U.S. Pat. Nos. 6,156,878; 6,242,566; 6,528,055; 6,528,623; 7,098,184; and 7,125,670, which also describe proteins comprising the soluble form of OX40L linked to other peptides, such as human immunoglobulin ("Ig") Fc regions, that can be produced to facilitate purification of OX40 ligand from cultured cells, or to enhance the stability of the molecule after in vivo administration to a mammal (see also, U.S. Pat. Nos. 5,457,035 and 7,959,925, both of which are incorporated by reference herein in their entireties).

Also included within the definition of OX40L are OX40 ligand variants which vary in amino acid sequence from naturally occurring OX40 ligand molecules but which retain the ability to specifically bind to an OX40 receptor. Such variants are described in U.S. Pat. Nos. 5,457,035; 6,156,878; 6,242,566; 6,528,055; 6,528,623; 7,098,184; and 7,125,670. In a related embodiment, a mutant of OX40L which has lost the ability to specifically bind to OX40, for example amino acids 51 to 183, in which the phenylalanine at position 180 of the receptor-binding domain of human OX40L has been replaced with alanine (F180A) is used.

OX40 agonists include a fusion protein in which one or more domains of OX40L is covalently linked to one or more additional protein domains. Exemplary OX40L fusion proteins that can be used as OX40 agonists are described in U.S. Pat. No. 6,312,700, the disclosure of which is incorporated herein by reference in its entirety. In one embodiment, an OX40 agonist includes an OX40L fusion polypeptide that self-assembles into a multimeric (e.g., trimeric or hexameric) OX40L fusion protein. Such fusion proteins are described, e.g., in U.S. Pat. No. 7,959,925, which is incorporated by reference herein in its entirety. The multimeric OX40L fusion protein exhibits increased efficacy in enhancing antigen specific immune response in a subject, particularly a human subject, due to its ability to spontaneously assemble into highly stable trimers and hexamers.

In another embodiment, an OX40 agonist capable of assembling into a multimeric form includes a fusion polypeptide comprising in an N-terminal to C-terminal direction: an immunoglobulin domain, wherein the immunoglobulin domain includes an Fc domain, a trimerization domain, wherein the trimerization domain includes a coiled coil trimerization domain, and a receptor binding domain, wherein the receptor binding domain is an OX40 receptor binding domain, e.g., an OX40L or an OX40-binding fragment, variant, or derivative thereof, where the fusion polypeptide can self-assemble into a trimeric fusion protein. In one aspect, an OX40 agonist capable of assembling into a multimeric form is capable of binding to the OX40 receptor and stimulating at least one OX40 mediated activity. In certain aspects, the OX40 agonist includes an extracellular domain of OX40 ligand.

The trimerization domain of an OX40 agonist capable of assembling into a multimeric form serves to promote self-assembly of individual OX40L fusion polypeptide molecules into a trimeric protein. Thus, an OX40L fusion polypeptide with a trimerization domain self-assembles into a trimeric OX40L fusion protein. In one aspect, the trimerization domain is an isoleucine zipper domain or other coiled coli polypeptide structure. Exemplary coiled coil trimerization domains include: TRAF2 (GENBANK® Accession No. Q12933, amino acids 299-348; Thrombospondin 1 (Accession No. PO7996, amino acids 291-314; Matrilin-4 (Accession No. O95460, amino acids 594-618; CMP (matrilin-1) (Accession No. NP-002370, amino acids 463-496; HSF1 (Accession No. AAX42211, amino acids 165-191; and Cubilin (Accession No. NP-001072, amino acids 104-138. In certain specific aspects, the trimerization domain includes a TRAF2 trimerization domain, a Matrilin-4 trimerization domain, or a combination thereof.

OX40L FP is a human OX40 ligand IgG4P fusion protein that specifically binds to, and triggers signaling by, the human OX40 receptor, a member of the TNFR superfamily. OX40L FP is also disclosed in US2016/0024176, incorporated herein by reference in its entirety. OX40L FP is composed of three distinct domains: (1) human OX40 ligand extracellular receptor binding domains (RBDs) that form homotrimers and bind the OX40 receptor; (2) isoleucine zipper trimerization domains derived from TNFR-associated factor 2 that stabilize the homotrimeric structure of the OX40 ligand RBDs; and (3) human IgG4 fragment crystallizable gamma (Fcγ) domains that facilitate Fcγ receptor clustering of the fusion protein when bound to OX40 receptors, and contain a serine to proline substitution at position 228 (according to EU numbering) in the hinge regions (IgG4P) to promote stability of two sets of OX40 ligand RBD homotrimers. The IgG4P Fc domain is fused directly to an isoleucine zipper trimerization domain derived from amino acid residues 310-349 of human tumor necrosis factor 2 (TRAF2). Fused to the c-terminus of the TRAF2 domain are amino acid residues 51-183 of the extracellular receptor binding domain (RBD) of human OX40L (gene name TNFSF4). The TRAF2 domain stabilizes the homotrimeric structure of OX40L RBDs to enable OX40 binding and activation, while the IgG4P Fc domain confers serum stability, dimerization of OX40L trimers, and facilitates Fcγ receptor clustering of the hexameric fusion protein. One OX40L FP variant possesses a phenylalanine (F) to alanine (A) mutation at the amino acid corresponding to position 180 in OX40L. Another OX40L FP variant has the IgG4P Fc domain replaced with a human IgG1 Fc domain. In particular embodiments, the OX40 agonist for use in the present disclosure is one of the OX40L FP variants.

In particular embodiments, the OX40 agonist for use in the present disclosure has been modified to increase its serum half-life. For example, the serum half-life of an OX40 agonist can be increased by conjugation to a heterologous molecule such as serum albumin, an antibody Fc region, or PEG. In certain embodiments, OX40 agonists can be conjugated to other therapeutic agents or toxins to form immunoconjugates and/or fusion proteins. In certain embodiments, the OX40 agonist can be formulated so as to facilitate administration and promote stability of the active agent.

Antibody Derivatives

Antibodies for use in the present disclosure (e.g., anti-CTLA-4, anti-PD-L1, anti-PD-1, anti-OX40) may include variants of these sequences that retain the ability to specifically bind their targets. Such variants may be derived from the sequence of these antibodies by a skilled artisan using techniques well known in the art. For example, amino acid substitutions, deletions, or additions, can be made in the FRs and/or in the CDRs. While changes in the FRs are usually designed to improve stability and immunogenicity of the antibody, changes in the CDRs are typically designed to increase affinity of the antibody for its target. Variants of FRs also include naturally occurring immunoglobulin allotypes. Such affinity-increasing changes may be determined empirically by routine techniques that involve altering the CDR and testing the affinity antibody for its target. For example, conservative amino acid substitutions can be made within any one of the disclosed CDRs. Various alterations can be made according to the methods described in Antibody Engineering, 2nd ed., Oxford University Press, ed. Borrebaeck, 1995. These include but are not limited to nucleotide sequences that are altered by the substitution of different codons that encode a functionally equivalent amino acid residue within the sequence, thus producing a "silent" change. For example, the nonpolar amino acids include alanine, leucine, isoleucine, valine, proline, phenylalanine, tryptophan, and methionine. The polar neutral amino acids include glycine, serine, threonine, cysteine, tyrosine, asparagine, and glutamine. The positively charged (basic) amino acids include arginine, lysine, and histidine. The negatively charged (acidic) amino acids include aspartic acid and glutamic acid.

Derivatives and analogs of antibodies of the present disclosure can be produced by various techniques well known in the art, including recombinant and synthetic methods (Maniatis (1990) Molecular Cloning, A Laboratory Manual, 2nd ed., Cold Spring Harbor Laboratory, Cold Spring Harbor, N.Y., and Bodansky et al. (1995) The Practice of Peptide Synthesis, 2nd ed., Spring Verlag, Berlin, Germany). Analogous shuffling or combinatorial techniques are also disclosed by Stemmer (Nature (1994) 370: 389-391), who describes the technique in relation to a β-lactamase gene but observes that the approach may be used for the generation of antibodies.

One may generate novel VH or VL regions carrying one or more sequences derived from the sequences disclosed herein using random mutagenesis of one or more selected VH and/or VL genes. One such technique, error-prone PCR, is described by Gram et al. (Proc. Nat. Acad. Sci. U.S.A. (1992) 89: 3576-3580).

Another method that may be used is to direct mutagenesis to CDRs of VH or VL genes. Such techniques are disclosed by Barbas et al. (Proc. Nat. Acad. Sci. U.S.A. (1994) 91: 3809-3813) and Schier et al. (J. Mol. Biol. (1996) 263: 551-567).

Similarly, one or more, or all three CDRs may be grafted into a repertoire of VH or VL domains, which are then screened for an antigen-binding fragment specific for CTLA-4 or PD-L1.

A portion of an immunoglobulin variable domain will comprise at least one of the CDRs substantially as set out herein and, optionally, intervening framework regions from the scFv fragments as set out herein. The portion may include at least about 50% of either or both of FR1 and FR4, the 50% being the C-terminal 50% of FR1 and the N-terminal 50% of FR4. Additional residues at the N-terminal or C-terminal end of the substantial part of the variable domain may be those not normally associated with naturally occurring variable domain regions. For example, construction of antibodies by recombinant DNA techniques may result in the introduction of N- or C-terminal residues encoded by linkers introduced to facilitate cloning or other manipulation steps. Other manipulation steps include the introduction of linkers to join variable domains to further protein sequences including immunoglobulin heavy chain constant regions, other variable domains (for example, in the production of diabodies), or proteinaceous labels as discussed in further detail below.

A skilled artisan will recognize that antibodies for use in the present disclosure may comprise antigen-binding fragments containing only a single CDR from either VL or VH domain. Either one of the single chain specific binding domains can be used to screen for complementary domains capable of forming a two-domain specific antigen-binding fragment capable of, for example, binding to CTLA-4 and PD-L1.

Antibodies for use in the present disclosure described herein can be linked to another functional molecule, e.g., another peptide or protein (albumin, another antibody, etc.). For example, the antibodies can be linked by chemical cross-linking or by recombinant methods. The antibodies may also be linked to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192; or 4,179,337. The antibodies can be chemically modified by covalent conjugation to a polymer, for example, to increase their circulating half-life. Exemplary polymers and methods to attach them are also shown in U.S. Pat. Nos. 4,766,106; 4,179,337; 4,495,285, and 4,609,546.

The antibodies may also be altered to have a glycosylation pattern that differs from the native pattern. For example, one or more carbohydrate moieties can be deleted and/or one or more glycosylation sites added to the original antibody. Addition of glycosylation sites to the presently disclosed antibodies may be accomplished by altering the amino acid sequence to contain glycosylation site consensus sequences known in the art. Another means of increasing the number of carbohydrate moieties on the antibodies is by chemical or enzymatic coupling of glycosides to the amino acid residues of the antibody. Such methods are described in WO 87/05330, and in Aplin et al. (1981) CRC Crit. Rev. Biochem., 22: 259-306. Removal of any carbohydrate moieties from the antibodies may be accomplished chemically or enzymatically, for example, as described by Hakimuddin et al. (1987) Arch. Biochem. Biophys., 259: 52; and Edge et al. (1981) Anal. Biochem., 118: 131 and by Thotakura et al. (1987) Meth. Enzymol., 138: 350. The antibodies may also be tagged with a detectable, or functional, label. Detectable labels include radiolabels such as 131I or 99Tc, which may also be attached to antibodies using conventional chemistry. Detectable labels also include enzyme labels such as horseradish peroxidase or alkaline phosphatase. Detectable labels further include chemical moieties such as biotin, which may be detected via binding to a specific cognate detectable moiety, e.g., labeled avidin.

Antibodies, in which CDR sequences differ only insubstantially from those set forth herein are encompassed within the scope of this present disclosure. Typically, an amino acid is substituted by a related amino acid having similar charge, hydrophobic, or stereochemical characteristics. Such substitutions would be within the ordinary skills of an artisan. Unlike in CDRs, more substantial changes can be made in FRs without adversely affecting the binding properties of an antibody. Changes to FRs include, but are not limited to, humanizing a non-human derived or engineering certain framework residues that are important for antigen contact or for stabilizing the binding site, e.g., changing the class or subclass of the constant region, changing specific amino acid residues which might alter the effector function such as Fc receptor binding, e.g., as described in U.S. Pat. Nos. 5,624,821 and 5,648,260 and Lund et al. (1991) J. Immun. 147: 2657-2662 and Morgan et al. (1995) Immunology 86: 319-324, or changing the species from which the constant region is derived.

One of skill in the art will appreciate that the modifications described above are not all-exhaustive, and that many other modifications would be obvious to a skilled artisan in light of the teachings of the present disclosure.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide consists of 12-30 linked nucleosides and the second modified oligonucleotide consists of 12-30 linked nucleosides. In certain embodiments, one of the modified oligonucleotides has a nucleobase sequence comprising at least 8 contiguous nucleobases of any of SEQ ID NOs: 23-2940.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide consisting of 10 to 30 linked subunits. In certain embodiments, a compound described herein comprises an oligonucleotide consisting of 12 to 30 linked subunits. In certain embodiments, a compound described herein comprises an oligonucleotide consisting of 12 to 22 linked subunits. In certain embodiments, a compound described herein comprises an oligonucleotide consisting of 14 to 30 linked subunits. In certain embodiments, compound described herein comprises an oligonucleotide consisting of 14 to 20 linked subunits. In certain embodiments, a compound described herein comprises an oligonucleotide consisting of 15 to 30 linked subunits. In certain embodiments, a compound described herein comprises an oligonucleotide consisting of 15 to 20 linked subunits. In certain embodiments, a compound described herein comprises an oligonucleotide consisting of 16 to 30 linked subunits. In certain embodiments, a compound described herein comprises an oligonucleotide consisting of 16 to 20 linked subunits. In certain embodiments, a compound described herein comprises an oligonucleotide consisting of 17 to 30 linked subunits. In certain embodiments, a compound described herein comprises an oligonucleotide consisting of 17 to 20 linked subunits. In certain embodiments, a compound described herein comprises an oligonucleotide consisting of 18 to 30 linked subunits. In certain embodiments, a compound described herein comprises an oligonucleotide consisting of 18 to 21 linked subunits. In certain embodiments, a compound described herein comprises an oligonucleotide consisting of 18 to 20 linked subunits. In certain embodiments, a compound described herein comprises an oligonucleotide consisting of 20 to 30 linked subunits. In other words, such oligonucleotides consist of 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, a compound described herein comprises an oligonucleotide consisting of 14 linked subunits. In certain embodiments, a compound described herein comprises an oligonucleotide consisting of 16 linked subunits. In certain embodiments, a compound described herein comprises an oligonucleotide consisting of 17 linked subunits. In certain embodiments, compound described herein comprises an oligonucleotide consisting of 18 linked subunits. In certain embodiments, a compound described herein comprises an oligonucleotide consisting of 19 linked subunits. In certain embodiments, a compound described herein comprises an oligonucleotide consisting of 20 linked subunits. In other embodiments, a compound described herein comprises an oligonucleotide consisting of 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide consisting of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an YAP1 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst.* March 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to YAP1 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 23-2940 and a second strand. In certain embodiments, the compound comprises a first strand comprising the nucleobase sequence of any one of SEQ ID NOs: 23-2940 and a second strand. In certain embodiments, the compound comprises ribonucleotides in which the first strand has uracil (U) in place of thymine (T) in any one of SEQ ID NOs: 23-2940. In certain embodiments, the compound comprises (i) a first strand comprising a nucleobase sequence complementary to the site on YAP1 to which any of SEQ ID NOs: 23-2940 is targeted, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound consists of 16, 17, 18, 19, 20, 21, 22, or 23 linked nucleosides. In certain embodiments, the first or second strand of the compound can comprise a conjugate group.

In certain embodiments, a compound described herein can comprise any of the oligonucleotide sequences targeted to YAP1 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 23-2940. In certain embodiments, the compound comprises the nucleobase sequence of any one of SEQ ID NOs: 23-2940. In certain embodiments, the compound comprises ribonucleotides in which uracil (U) is in place of thymine (T) in any one of SEQ ID NOs: 23-2940. In certain embodiments, the compound comprises a nucleobase sequence complementary to the site on YAP1 to which any of SEQ ID NOs: 23-2940 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

In certain embodiments, compounds described herein comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1H$ hydrogen atoms. Isotopic substitutions encompassed by the compounds herein include but are not limited to: $^2H$ or $^3H$ in place of $^1H$, $^{13}C$ or $^{14}C$ in place of $^{12}C$, $^{15}N$ in place of $^{14}N$, $^{17}O$ or $^{18}O$ in place of $^{16}O$, and $^{33}S$, $^{34}S$, $^{35}S$, or $^{36}S$ in place of $^{32}S$. In certain embodiments, non-radioactive isotopic substitutions may impart new properties on the compound that are beneficial for use as a therapeutic or research tool. In certain embodiments, radioactive isotopic substitutions may make the compound suitable for research or diagnostic purposes, such as an imaging assay.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode YAP1 include, without limitation, the following: GENBANK or RefSEQ No. NM_001282101.1 (SEQ ID NO: 1); NC_000011.10 truncated from nucleotides 102107001 to 102236000 (SEQ ID NO: 2); NM_006106.4 (SEQ ID NO: 3); NM_001130145.2 (SEQ ID NO: 4); NM_001195044.1 (SEQ ID NO: 5); NM_001195045.1 (SEQ ID NO: 6); NM_001282097.1 (SEQ ID NO: 7); NM_001282098.1 (SEQ ID NO: 8); NM_001282099.1 (SEQ ID NO: 9); and NM_001282100.1 (SEQ ID NO: 10), each of which is incorporated by reference in its entirety.

Hybridization

In some embodiments, hybridization occurs between a compound disclosed herein and a YAP1 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a YAP1 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a YAP1 nucleic acid may be tolerated provided that the compound remains able to specifically hybridize to a target nucleic acid. Moreover, a compound may hybridize over one or more segments of a YAP1 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a YAP1 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a YAP1 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which consists of 18 nucleotides having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a YAP1 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a YAP1 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a YAP1 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the— compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of a compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modifed sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more acyclic substituent, including but not limited to substituents at the 2', 4', and/or 5' positions. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$("MOE"). In certain embodiments, 2'-substituent groups are selected from among: halo, allyl, amino, azido, SH, CN, OCN, CF$_3$, OCF$_3$, alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for linearly non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., US2010/190837 and Rajeev et al., US2013/0203836.

In certain embodiments, a 2'-substituted nucleoside or 2'-non-bicyclic modified nucleoside comprises a sugar moiety comprising a linear 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)—N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside or 2'-non-bicyclic modified nucleoside comprises a sugar moiety comprising a linear 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)—N(H)CH_3$ ("NMA").

In certain embodiments, a 2'-substituted nucleoside or 2'-non-bicyclic modified nucleoside comprises a sugar moiety comprising a linear 2'-substituent group selected from: F, $OCH_3$, and $OCH_2CH_2OCH_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modfed sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-$(CH_2)_2$-2', 4'-$(CH_2)_3$-2', ("LNA"), 4'-$(CH_2)_2$—O-2' ("ENA"), 4'-$CH(CH_3)$—O-2' (referred to as "constrained ethyl" or "cEt" when in the S configuration), 4'-$CH_2$—O—$CH_2$-2', 4'-$CH_2$—N(R)-2', 4'-$CH(CH_2OCH_3)$—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—N($OCH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., *J. Org. Chem.*, 2009, 74, 118-134), 4'-$CH_2$—C(=$CH_2$)-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[$C(R_a)(R_b)$]$_n$—, —[$C(R_a)(R_b)$]$_n$—O—, —$C(R_a)=C(R_b)$—, —$C(R_a)=N$—, —$C(=NR_a)$—, —$C(=O)$—, —$C(=S)$—, —O—, —$Si(R_a)_2$—, —$S(=O)_x$—, and —$N(R_a)$—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl ($S(=O)_2$-$J_1$), or sulfoxyl ($S(=O)$-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

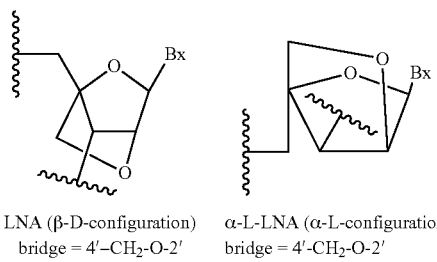

LNA (β-D-configuration)
bridge = 4'–CH$_2$-O-2'

α-L-LNA (α-L-configuration)
bridge = 4'-CH$_2$-O-2'

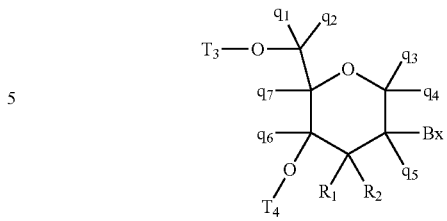

α-L-methyleneoxy (4'-CH$_2$—O-2') or α-L-LNA bicyclic nucleosides have been incorporated into oligonucleotides that showed antisense activity (Frieden et al., *Nucleic Acids Research,* 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002,10, 841-854), fluoro HNA:

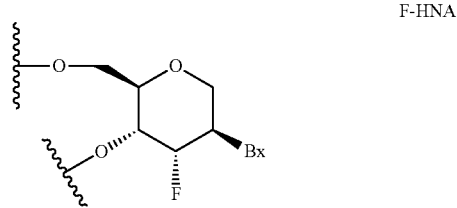

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906, F-HNA can also be referred to as a F-THP or 3'-fluoro tetrahydropyran), and nucleosides comprising additional modified THP compounds having the formula:

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

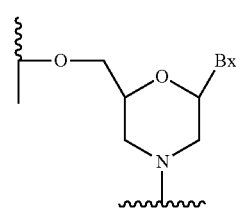

In certain embodiments, morpholinos may be modified, for example by adding or altering various substituent groups from the above morpholino structure. Such sugar surrogates are refered to herein as "modifed morpholinos."

In certain embodiments, sugar surrogates comprise acyclic moieites. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimi¬dines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH3) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a YAP1 nucleic acid comprise one or more modified nucleobases. In certain embodiments, the modified nucleobase is 5-methylcytosine. In certain embodiments, each cytosine is a 5-methylcytosine.

3. Modified Internucleoside Linkages

The naturally occuring internucleoside linkage of RNA and DNA is a 3' to 5' phosphodiester linkageIn certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

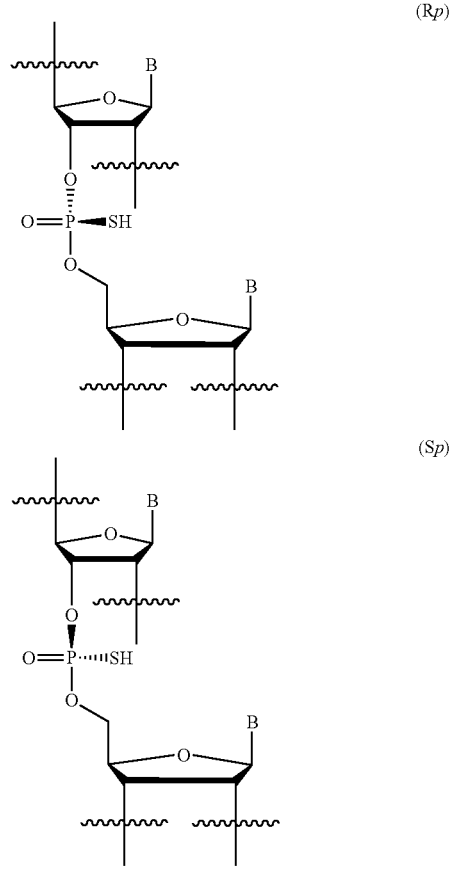

Unless otherwise indicated, chiral internucleoside linkages of modified oligonucleotides described herein can be stereorandom or in a particular stereochemical configuration.

In certain embodiments, compounds targeted to an YAP1 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH2-N(CH3)-O—CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O—CH2-O-5), methoxypropyl, and thioformacetal (3'-S—CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

In certain embodiments, a modified oligonucleotide can comprise a sugar motif described in Swayze et al., US2010/0197762; Freier et al., US2014/0107330; Freier et al., US2015/0184153; and Seth et al., US2015/0267195, each of which is incorporated by reference in its entirety herein.

Certain embodiments provided herein are directed to modified oligomeric compounds useful for inhibiting target nucleic acid expression, which can be useful for treating, preventing, ameliorating, or slowing progression of a disease associated with such a target nucleic acid. In certain embodiments, the modified oligomeric compounds comprise antisense oligonucleotides that are gapmers having certain sugar motifs. In certain embodiments, the gapmer sugar motifs provided herein can be combined with any nucleobase sequence and any internucleoside linkage motif to form potent antisense oligonucleotides.

In certain embodiments, a method comprises contacting a cell or administering to a subject a compound comprising a modified oligonucleotide consisting of 16 linked nucleosides and having the motif: ekk-d9-kkee, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: k-d9-kekeke, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kkk-d8-kekek, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kkk-d9-keke, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kk-d9-kdkdk, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a compound comprises a modified oligonucleotide consisting of 16 linked nucleosides and having the motif: kk-d9-eeekk, wherein 'd' represents a 2'-deoxyribose sugar, 1' represents a cEt nucleoside, and 'e' represents a 2'-MOE nucleoside. In certain embodiments, a method comprises contacting a cell or administering to a subject a compound comprising a modified oligonucleotide consisting of 16 linked nucleosides and having the motif: kk-d9-eeekk, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kk-d9-ekeke, wherein represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearanceIn certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., *Proc. Natl. Acad. Sci. USA*, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides,* 1995, 14, 969-973), or adamantane acetic, a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, i, 923-937), a tocopherol group (Nishina et al., *Molecular Therapy Nucleic Acids,* 2015, 4, e220; doi:10.1038/mtna.2014.72 and Nishina et al., *Molecular Therapy,* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, a compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome.

In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to YAP1 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to YAP1 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound. In certain embodiments, the compounds or compositions further comprise a pharmaceutically acceptable carrier or diluent.

EXAMPLES

The Examples below describe the screening process to identify lead compounds targeted to YAP1. Out of over 3,000 oligonucleotides that were screened, ION 958499, 1076453, 1197270, 1198439, 1198440, 1198605, 1198623, 1198728, 1198831, or 1198872 emerged as the top lead compounds. In particular, ION 1198440 exhibited the best combination of properties in terms of potency and tolerability out of over 3,000 oligonucleotides.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1

Antisense Inhibition of Human Yap1 in A-431 Cells by cEt Gapmers

Modified oligonucleotides were designed to target a Yap1 nucleic acid and were tested for their effect on Yap1 mRNA level in vitro. The modified oligonucleotides were tested in a series of experiments that had similar culture conditions. The results for each experiment are presented in separate tables shown below. Cultured A-431 cells at a density of 5,000 cells per well were treated using free uptake with 2,000 nM of modified oligonucleotide. After a treatment period of approximately 48 hours, RNA was isolated from the cells and Yap1 mRNA levels were measured by quantitative real-time RTPCR. Human primer probe set RTS4814 (forward sequence GGGAAGTGAGCCTGTTTGGA, designated herein as SEQ ID NO.: 11; reverse sequence ACTGTTGAACAAACTAAATGCTGTGA, designated herein as SEQ ID NO.: 12; probe sequence ATGGATGC-CATTCCTTTTGCCCAGTT, designated herein as SEQ ID NO.: 13) was used to measure mRNA levels. Yap1 mRNA levels were normalized to total RNA content, as measured by RIBOGREEN®. Results are presented in the tables below as percent control of the amount of Yap1 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1 (GENBANK Accession No. NM_001282101.1), or SEQ ID NO.: 2 (GENBANK Accession No. NC_000011.10 truncated from nucleotides 102107001 to 102236000). 'N/A' indicates that the modified oligonucleotide does not target that particular gene sequence with 100% complementarity. 'N.D.' indicates that the % UTC is not defined for that particular modified oligonucleotide in that particular experiment. Activity of the modified oligonucleotide may be defined in a different experiment.

TABLE 1

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715400 | 559 | 574 | 4019 | 4034 | CTCCGAGTCCCCGCGG | 107 | 23 |
| 715403 | 658 | 673 | 4118 | 4133 | GAAGGAGTCGGGCAGC | 72 | 24 |
| 715406 | 664 | 679 | 4124 | 4139 | CTTGAAGAAGGAGTCG | 58 | 25 |
| 715409 | 704 | 719 | N/A | N/A | CAGTACTGGCCTGTCG | 76 | 26 |
| 715412 | 710 | 725 | 7144 | 7159 | CTGCATCAGTACTGGC | 66 | 27 |
| 715415 | 744 | 759 | 7178 | 7193 | CGAACATGCTGTGGAG | 24 | 28 |
| 715418 | 798 | 813 | 7232 | 7247 | AGTGTCCCAGGAGAAA | 126 | 29 |
| 715421 | 949 | 964 | N/A | N/A | GTGATTTAAGAAGTAT | 71 | 30 |
| 715424 | 972 | 987 | 55467 | 55482 | TGCCATGTTGTTGTCT | 58 | 31 |
| 715427 | 1081 | 1096 | 79022 | 79037 | CCATCCATCAGGAAGA | 90 | 32 |
| 715430 | 1102 | 1117 | 79043 | 79058 | ATCCTGAGTCATGGCT | 118 | 33 |
| 715433 | 1133 | 1148 | 79074 | 79089 | TGTTCTTATGGTTTAT | 36 | 34 |
| 715436 | 1178 | 1193 | N/A | N/A | TGGCAAAACGAGGGTC | 126 | 35 |
| 715439 | 1184 | 1199 | N/A | N/A | GGTTCATGGCAAAACG | 99 | 36 |
| 715442 | 1210 | 1225 | 98912 | 98927 | CACTGGAGCACTCTGA | 64 | 37 |
| 715445 | 1460 | 1475 | 116649 | 116664 | CATCCTGCTCCAGTGT | 87 | 38 |

TABLE 1-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715448 | 1509 | 1524 | 116698 | 116713 | CTCAATTCCTGAGACA | 97 | 39 |
| 715451 | 1516 | 1531 | 116705 | 116720 | CATTGTTCTCAATTCC | 75 | 40 |
| 715454 | 1558 | 1573 | N/A | N/A | ATAGGTGCCACTGTTA | 78 | 41 |
| 715457 | 1564 | 1579 | 120469 | 120484 | AGAGTGATAGGTGCCA | 47 | 42 |
| 715460 | 1570 | 1585 | 120475 | 120490 | ATCTCGAGAGTGATAG | 114 | 43 |
| 715463 | 1608 | 1623 | 120513 | 120528 | CTGTAGCTGCTCATGC | 73 | 44 |
| 715466 | 1751 | 1766 | 122776 | 122791 | CAAGGTCCACATTTGT | 83 | 45 |
| 715469 | 1870 | 1885 | 122895 | 122910 | TAGCTTGGTGGCAGCC | 94 | 46 |
| 715472 | 1876 | 1891 | 122901 | 122916 | TTTATCTAGCTTGGTG | 52 | 47 |
| 715475 | 1883 | 1898 | 122908 | 122923 | AGCTTTCTTTATCTAG | 103 | 48 |
| 715478 | 3560 | 3575 | 124585 | 124600 | ACCATTATTACTCCTG | 7 | 49 |
| 715481 | 3566 | 3581 | 124591 | 124606 | TTGGAAACCATTATTA | 66 | 50 |
| 715484 | 3572 | 3587 | 101152 124597 | 101167 124612 | TACTCTTTGGAAACCA | 123 | 51 |
| 715487 | 3630 | 3645 | 124655 | 124670 | ATTACTTCATAGCTTA | 22 | 52 |
| 715490 | 3636 | 3651 | 124661 | 124676 | CCAACTATTACTTCAT | 38 | 53 |
| 715493 | 3665 | 3680 | 124690 | 124705 | GTGCTAGCTGGTGCCA | 62 | 54 |
| 715496 | 3720 | 3735 | 124745 | 124760 | CCCTTGAAAATAAGGG | 124 | 55 |
| 715499 | 3726 | 3741 | 124751 | 124766 | TATGAACCCTTGAAAA | 126 | 56 |
| 715502 | 4011 | 4026 | 125036 | 125051 | CCAGACTTAATTCAAG | 91 | 57 |
| 715505 | 4684 | 4699 | 125709 | 125724 | ATTGGTTTATTGTAAA | 84 | 58 |
| 715508 | 1397 | 1412 | 102529 | 102544 | CTGTGCTGGGATTGAT | 24 | 59 |
| 715511 | 1419 | 1434 | N/A | N/A | TCCTGACATTTTGGAG | 107 | 60 |
| 715514 | N/A | N/A | 4573 | 4588 | GAGCGAAGGTGCGGAG | 121 | 61 |
| 715517 | N/A | N/A | 5151 | 5166 | GGCCTATGAGTCAACC | 109 | 62 |
| 715520 | N/A | N/A | 5544 | 5559 | TTCTTTCCACTCAAGT | 122 | 63 |
| 715523 | N/A | N/A | 7140 | 7155 | ATCAGTACTGGCCTAT | 32 | 64 |
| 715526 | N/A | N/A | 7385 | 7400 | ACTTACTTTAAGAAGT | 112 | 65 |
| 715529 | N/A | N/A | 8646 | 8661 | TGAAACCTGATCCTTT | 148 | 66 |
| 715532 | N/A | N/A | 8820 | 8835 | TAACAACCTGGTTTGT | 91 | 67 |
| 715535 | N/A | N/A | 8906 | 8921 | CTATTAAGCTGTTTAA | 91 | 68 |
| 715538 | N/A | N/A | 10383 | 10398 | CTTTGTAACTTAAAAG | 110 | 69 |
| 715541 | N/A | N/A | 10918 | 10933 | CTTGAAGAACTATTTC | 105 | 70 |
| 715544 | N/A | N/A | 10924 | 10939 | CAACTACTTGAAGAAC | 128 | 71 |
| 715547 | N/A | N/A | 10930 | 10945 | GTTGACCAACTACTTG | 98 | 72 |
| 715550 | N/A | N/A | 10938 | 10953 | AGGAAGTTGTTGACCA | 70 | 73 |
| 715553 | N/A | N/A | 10944 | 10959 | AGAAATAGGAAGTTGT | 90 | 74 |

TABLE 1-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715556 | N/A | N/A | 10965 | 10980 | AAGTTATTCAGCAGCT | 63 | 75 |
| 715559 | N/A | N/A | 28556 | 28571 | CTGCCATTTAAGAAAT | 114 | 76 |
| 715562 | N/A | N/A | 37601 | 37616 | CACACAACTCAGACAG | 77 | 77 |
| 715565 | N/A | N/A | 37826 | 37841 | GGATAAATGAATTATA | 115 | 78 |
| 715568 | N/A | N/A | 37832 | 37847 | AAGGTAGGATAAATGA | 116 | 79 |
| 715571 | N/A | N/A | 105518 | 105533 | AAAATCCTGCCAACAT | 127 | 80 |
| 715574 | N/A | N/A | 79119 | 79134 | TACCAAAACGAGGGTC | 118 | 81 |
| 715577 | N/A | N/A | 80085 | 80100 | GCATTCACAGAGTTAA | 21 | 82 |
| 715580 | N/A | N/A | 80919 | 80934 | GCCTGTCTGGAATACA | 101 | 83 |
| 715583 | N/A | N/A | 80954 | 80969 | GGGCCACAAAATAAAA | 164 | 84 |
| 715586 | N/A | N/A | 80980 | 80995 | AAAAGGTCTGGAACAG | 53 | 85 |
| 715589 | N/A | N/A | 81086 | 81101 | CCAGCAGCTAACAGCT | 107 | 86 |
| 715592 | N/A | N/A | 81151 | 81166 | TTCTTTGGCAGAGATA | 89 | 87 |
| 715595 | N/A | N/A | 98883 | 98898 | TCATGGCTGAAATGAA | 104 | 88 |
| 715598 | N/A | N/A | 102395 | 102410 | CCCAAGCTACCCAAGA | 103 | 89 |
| 715601 | N/A | N/A | 102401 | 102416 | AGAATTCCCAAGCTAC | 106 | 90 |
| 715604 | N/A | N/A | 102407 | 102422 | TAGCACAGAATTCCCA | 107 | 91 |
| 715607 | N/A | N/A | 102413 | 102428 | TCACCATAGCACAGAA | 116 | 92 |
| 715610 | N/A | N/A | 102451 | 102466 | GGCTGTGTAGGCTGAC | 87 | 93 |
| 715613 | N/A | N/A | 102473 | 102488 | ATTACTTTAAGCCACA | 85 | 94 |
| 715616 | N/A | N/A | 102484 | 102499 | GACGGATAAAAATTAC | 95 | 95 |
| 715619 | N/A | N/A | 102490 | 102505 | AAATAAGACGGATAAA | 114 | 96 |
| 715622 | N/A | N/A | 102496 | 102511 | AGTAAAAATAAGACG | 137 | 97 |
| 715625 | N/A | N/A | 102506 | 102521 | ATTGCCTAAGAGTAAA | 99 | 98 |
| 715628 | N/A | N/A | 102555 | 102570 | GCCTACCTGACATTTT | 114 | 99 |
| 715631 | N/A | N/A | 102561 | 102576 | ATAAGAGCCTACCTGA | 134 | 100 |

TABLE 2

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715401 | 562 | 577 | 4022 | 4037 | GGTCTCCGAGTCCCCG | 84 | 101 |
| 715404 | 660 | 675 | 4120 | 4135 | AAGAAGGAGTCGGGCA | 64 | 102 |
| 715407 | 666 | 681 | 4126 | 4141 | GGCTTGAAGAAGGAGT | 53 | 103 |
| 715410 | 706 | 721 | N/A | N/A | ATCAGTACTGGCCTGT | 61 | 104 |
| 715413 | 740 | 755 | 7174 | 7189 | CATGCTGTGGAGTCAG | 96 | 105 |

TABLE 2-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715416 | 746 | 761 | 7180 | 7195 | CTCGAACATGCTGTGG | 53 | 106 |
| 715419 | 929 | 944 | 7363 | 7378 | GACCAGAAGATGTCTT | 107 | 107 |
| 715422 | 968 | 983 | 55463 | 55478 | ATGTTGTTGTCTGATC | 57 | 108 |
| 715425 | 976 | 991 | 55471 | 55486 | GTCCTGCCATGTTGTT | 98 | 109 |
| 715428 | 1083 | 1098 | 79024 | 79039 | TCCCATCCATCAGGAA | 106 | 110 |
| 715431 | 1104 | 1119 | 79045 | 79060 | CCATCCTGAGTCATGG | 99 | 111 |
| 715434 | 1136 | 1151 | 79077 | 79092 | TCTTGTTCTTATGGTT | 31 | 112 |
| 715437 | 1180 | 1195 | N/A | N/A | CATGGCAAAACGAGGG | 89 | 113 |
| 715440 | 1186 | 1201 | N/A | N/A | CTGGTTCATGGCAAAA | 85 | 114 |
| 715443 | 1212 | 1227 | 98914 | 98929 | TTCACTGGAGCACTCT | 40 | 115 |
| 715446 | 1505 | 1520 | 116694 | 116709 | ATTCCTGAGACATCCC | 81 | 116 |
| 715449 | 1511 | 1526 | 116700 | 116715 | TTCTCAATTCCTGAGA | 124 | 117 |
| 715452 | 1518 | 1533 | 116707 | 116722 | GTCATTGTTCTCAATT | 71 | 118 |
| 715455 | 1560 | 1575 | N/A | N/A | TGATAGGTGCCACTGT | 65 | 119 |
| 715458 | 1566 | 1581 | 120471 | 120486 | CGAGAGTGATAGGTGC | 58 | 120 |
| 715461 | 1572 | 1587 | 120477 | 120492 | TCATCTCGAGAGTGAT | 153 | 121 |
| 715464 | 1745 | 1760 | 122770 | 122785 | CCACATTTGTCCCAGG | 89 | 122 |
| 715467 | 1769 | 1784 | 122794 | 122809 | CATCTCCTTCCAGTGT | 77 | 123 |
| 715470 | 1872 | 1887 | 122897 | 122912 | TCTAGCTTGGTGGCAG | 83 | 124 |
| 715473 | 1878 | 1893 | 122903 | 122918 | TCTTTATCTAGCTTGG | 32 | 125 |
| 715476 | 1885 | 1900 | 122910 | 122925 | AAAGCTTTCTTTATCT | 84 | 126 |
| 715479 | 3562 | 3577 | 124587 | 124602 | AAACCATTATTACTCC | 38 | 127 |
| 715482 | 3568 | 3583 | 124593 | 124608 | CTTTGGAAACCATTAT | 58 | 128 |
| 715485 | 3574 | 3589 | 124599 | 124614 | AATACTCTTTGGAAAC | 72 | 129 |
| 715488 | 3632 | 3647 | 124657 | 124672 | CTATTACTTCATAGCT | 66 | 130 |
| 715491 | 3638 | 3653 | 124663 | 124678 | AACCAACTATTACTTC | 71 | 131 |
| 715494 | 3668 | 3683 | 124693 | 124708 | GAGGTGCTAGCTGGTG | 46 | 132 |
| 715497 | 3722 | 3737 | 124747 | 124762 | AACCCTTGAAAATAAG | 155 | 133 |
| 715500 | 3966 | 3981 | 11043 124991 | 11058 125006 | AAGCCTTAGAGTCAAT | 30 | 134 |
| 715503 | 4013 | 4028 | 125038 | 125053 | CCCCAGACTTAATTCA | 136 | 135 |
| 715506 | 4686 | 4701 | 125711 | 125726 | AAATTGGTTTATTGTA | 112 | 136 |
| 715509 | 1399 | 1414 | 102531 | 102546 | TGCTGTGCTGGGATTG | 42 | 137 |
| 715512 | N/A | N/A | 4550 | 4565 | AGGCGCGCGCATTGTG | 97 | 138 |
| 715515 | N/A | N/A | 5147 | 5162 | TATGAGTCAACCTGCA | 94 | 139 |
| 715518 | N/A | N/A | 5477 | 5492 | TTTGGGCAAAGTTCCT | 60 | 140 |
| 715521 | N/A | N/A | 5546 | 5561 | TCTTCTTTCCACTCAA | 72 | 141 |

TABLE 2-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715524 | N/A | N/A | 7381 | 7396 | ACTTTAAGAAGTATCT | 93 | 142 |
| 715527 | N/A | N/A | 7387 | 7402 | TCACTTACTTTAAGAA | 111 | 143 |
| 715530 | N/A | N/A | 8816 | 8831 | AACCTGGTTTGTTTCC | 61 | 144 |
| 715533 | N/A | N/A | 8822 | 8837 | CCTAACAACCTGGTTT | 97 | 145 |
| 715536 | N/A | N/A | 8908 | 8923 | GGCTATTAAGCTGTTT | 137 | 146 |
| 715539 | N/A | N/A | 10637 | 10652 | AGATCTCACTGACCTA | 102 | 147 |
| 715542 | N/A | N/A | 10920 | 10935 | TACTTGAAGAACTATT | 120 | 148 |
| 715545 | N/A | N/A | 10926 | 10941 | ACCAACTACTTGAAGA | 87 | 149 |
| 715548 | N/A | N/A | 10934 | 10949 | AGTTGTTGACCAACTA | 117 | 150 |
| 715551 | N/A | N/A | 10940 | 10955 | ATAGGAAGTTGTTGAC | 82 | 151 |
| 715554 | N/A | N/A | 10961 | 10976 | TATTCAGCAGCTTATA | 93 | 152 |
| 715557 | N/A | N/A | 10967 | 10982 | GGAAGTTATTCAGCAG | 46 | 153 |
| 715560 | N/A | N/A | 37563 | 37578 | CCCTTTACAAAAATAG | 98 | 154 |
| 715563 | N/A | N/A | 37603 | 37618 | AGCACACAACTCAGAC | 86 | 155 |
| 715566 | N/A | N/A | 37828 | 37843 | TAGGATAAATGAATTA | 94 | 156 |
| 715569 | N/A | N/A | 37834 | 37849 | CAAAGGTAGGATAAAT | 122 | 157 |
| 715572 | N/A | N/A | 78867 | 78882 | TCAGAGAAGAAAGGTA | 97 | 158 |
| 715575 | N/A | N/A | 79123 | 79138 | CCTTTACCAAAACGAG | 134 | 159 |
| 715578 | N/A | N/A | 80087 | 80102 | TGGCATTCACAGAGTT | 50 | 160 |
| 715581 | N/A | N/A | 80921 | 80936 | AAGCCTGTCTGGAATA | 106 | 161 |
| 715584 | N/A | N/A | 80976 | 80991 | GGTCTGGAACAGATTA | 96 | 162 |
| 715587 | N/A | N/A | 80982 | 80997 | TGAAAAGGTCTGGAAC | 79 | 163 |
| 715590 | N/A | N/A | 81147 | 81162 | TTGGCAGAGATAAAAC | 84 | 164 |
| 715593 | N/A | N/A | 81153 | 81168 | ATTTCTTTGGCAGAGA | 60 | 165 |
| 715596 | N/A | N/A | 98885 | 98900 | GTTCATGGCTGAAATG | 104 | 166 |
| 715599 | N/A | N/A | 102397 | 102412 | TTCCCAAGCTACCCAA | 82 | 167 |
| 715602 | N/A | N/A | 102403 | 102418 | ACAGAATTCCCAAGCT | 110 | 168 |
| 715605 | N/A | N/A | 102409 | 102424 | CATAGCACAGAATTCC | 112 | 169 |
| 715608 | N/A | N/A | 102430 | 102445 | AATTGTATCCAGACAT | 100 | 170 |
| 715611 | N/A | N/A | 102469 | 102484 | CTTTAAGCCACATGGT | 106 | 171 |
| 715614 | N/A | N/A | 102475 | 102490 | AAATTACTTTAAGCCA | 110 | 172 |
| 715617 | N/A | N/A | 102486 | 102501 | AAGACGGATAAAAATT | 98 | 173 |
| 715620 | N/A | N/A | 102492 | 102507 | AAAAATAAGACGGATA | 111 | 174 |
| 715623 | N/A | N/A | 102502 | 102517 | CCTAAGAGTAAAAAAT | 113 | 175 |
| 715626 | N/A | N/A | 102551 | 102566 | ACCTGACATTTTGGAG | 64 | 176 |

TABLE 2-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715629 | N/A | N/A | 102557 | 102572 | GAGCCTACCTGACATT | 112 | 177 |
| 715632 | N/A | N/A | 109609 | 109624 | ATCCAATTATGTCCCA | 109 | 178 |

TABLE 3

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715402 | 656 | 671 | 4116 | 4131 | AGGAGTCGGGCAGCTT | 59 | 179 |
| 715405 | 662 | 677 | 4122 | 4137 | TGAAGAAGGAGTCGGG | 60 | 180 |
| 715408 | 668 | 683 | 4128 | 4143 | GCGGCTTGAAGAAGGA | 60 | 181 |
| 715411 | 708 | 723 | 7142 | 7157 | GCATCAGTACTGGCCT | 94 | 182 |
| 715414 | 742 | 757 | 7176 | 7191 | AACATGCTGTGGAGTC | 31 | 183 |
| 715417 | 749 | 764 | 7183 | 7198 | GAGCTCGAACATGCTG | 104 | 184 |
| 715420 | 947 | 962 | N/A | N/A | GATTTAAGAAGTATCT | 107 | 185 |
| 715423 | 970 | 985 | 55465 | 55480 | CCATGTTGTTGTCTGA | 30 | 186 |
| 715426 | 1079 | 1094 | 79020 | 79035 | ATCCATCAGGAAGAGG | 80 | 187 |
| 715429 | 1100 | 1115 | 79041 | 79056 | CCTGAGTCATGGCTTG | 62 | 188 |
| 715432 | 1106 | 1121 | 79047 | 79062 | CTCCATCCTGAGTCAT | 65 | 189 |
| 715435 | 1138 | 1153 | 79079 | 79094 | GGTCTTGTTCTTATGG | 36 | 190 |
| 715438 | 1182 | 1197 | N/A | N/A | TTCATGGCAAAACGAG | 82 | 191 |
| 715441 | 1188 | 1203 | N/A | N/A | CTCTGGTTCATGGCAA | 57 | 192 |
| 715444 | 1249 | 1264 | 98951 | 98966 | TCCCTGTGGGCTCTGG | 84 | 193 |
| 715447 | 1507 | 1522 | 116696 | 116711 | CAATTCCTGAGACATC | 81 | 194 |
| 715450 | 1514 | 1529 | 116703 | 116718 | TTGTTCTCAATTCCTG | 53 | 195 |
| 715453 | 1556 | 1571 | N/A | N/A | AGGTGCCACTGTTAAG | 59 | 196 |
| 715456 | 1562 | 1577 | 120467 | 120482 | AGTGATAGGTGCCACT | 96 | 197 |
| 715459 | 1568 | 1583 | 120473 | 120488 | CTCGAGAGTGATAGGT | 93 | 198 |
| 715462 | 1574 | 1589 | 120479 | 120494 | TCTCATCTCGAGAGTG | 94 | 199 |
| 715465 | 1747 | 1762 | 122772 | 122787 | GTCCACATTTGTCCCA | 91 | 200 |
| 715468 | 1868 | 1883 | 122893 | 122908 | GCTTGGTGGCAGCCAA | 90 | 201 |
| 715471 | 1874 | 1889 | 122899 | 122914 | TATCTAGCTTGGTGGC | 36 | 202 |
| 715474 | 1881 | 1896 | 122906 | 122921 | CTTTCTTTATCTAGCT | 78 | 203 |
| 715477 | 3543 | 3558 | 124568 | 124583 | AGACACATACTCTAGT | 61 | 204 |
| 715480 | 3564 | 3579 | 124589 | 124604 | GGAAACCATTATTACT | 23 | 205 |
| 715483 | 3570 | 3585 | 124595 | 124610 | CTCTTTGGAAACCATT | 15 | 206 |

TABLE 3-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715486 | 3628 | 3643 | 124653 | 124668 | TACTTCATAGCTTATA | 27 | 207 |
| 715489 | 3634 | 3649 | 124659 | 124674 | AACTATTACTTCATAG | 90 | 208 |
| 715492 | 3663 | 3678 | 124688 | 124703 | GCTAGCTGGTGCCACT | 76 | 209 |
| 715495 | 3671 | 3686 | 124696 | 124711 | ACAGAGGTGCTAGCTG | 80 | 210 |
| 715498 | 3724 | 3739 | 124749 | 124764 | TGAACCCTTGAAAATA | 91 | 211 |
| 715501 | 3968 | 3983 | 64588 124993 | 64603 125008 | AAAAGCCTTAGAGTCA | 28 | 212 |
| 715504 | 4682 | 4697 | 125707 | 125722 | TGGTTTATTGTAAAAG | 70 | 213 |
| 715507 | 1391 | 1406 | 102523 | 102538 | TGGGATTGATATTCCG | 95 | 214 |
| 715510 | 1402 | 1417 | 102534 | 102549 | ATTTGCTGTGCTGGGA | 22 | 215 |
| 715513 | N/A | N/A | 4554 | 4569 | GCGGAGGCGCGCGCAT | 125 | 216 |
| 715516 | N/A | N/A | 5149 | 5164 | CCTATGAGTCAACCTG | 77 | 217 |
| 715519 | N/A | N/A | 5540 | 5555 | TTCCACTCAAGTTACA | 96 | 218 |
| 715522 | N/A | N/A | 5548 | 5563 | ACTCTTCTTTCCACTC | 87 | 219 |
| 715525 | N/A | N/A | 7383 | 7398 | TTACTTTAAGAAGTAT | 100 | 220 |
| 715528 | N/A | N/A | 8644 | 8659 | AAACCTGATCCTTTGA | 98 | 221 |
| 715531 | N/A | N/A | 8818 | 8833 | ACAACCTGGTTTGTTT | 94 | 222 |
| 715534 | N/A | N/A | 8885 | 8900 | TCCCCAGGTCAGCATG | 112 | 223 |
| 715537 | N/A | N/A | 10155 | 10170 | ACTTGGCACCAAAAGC | 122 | 224 |
| 715540 | N/A | N/A | 10916 | 10931 | TGAAGAACTATTTCCT | 82 | 225 |
| 715543 | N/A | N/A | 10922 | 10937 | ACTACTTGAAGAACTA | 72 | 226 |
| 715546 | N/A | N/A | 10928 | 10943 | TGACCAACTACTTGAA | 59 | 227 |
| 715549 | N/A | N/A | 10936 | 10951 | GAAGTTGTTGACCAAC | 66 | 228 |
| 715552 | N/A | N/A | 10942 | 10957 | AAATAGGAAGTTGTTG | 86 | 229 |
| 715555 | N/A | N/A | 10963 | 10978 | GTTATTCAGCAGCTTA | 21 | 230 |
| 715558 | N/A | N/A | 10969 | 10984 | CAGGAAGTTATTCAGC | 37 | 231 |
| 715561 | N/A | N/A | 37599 | 37614 | CACAACTCAGACAGGG | 69 | 232 |
| 715564 | N/A | N/A | 37605 | 37620 | CAAGCACACAACTCAG | 75 | 233 |
| 715567 | N/A | N/A | 37830 | 37845 | GGTAGGATAAATGAAT | 99 | 234 |
| 715570 | N/A | N/A | 37836 | 37851 | GCCAAAGGTAGGATAA | 79 | 235 |
| 715573 | N/A | N/A | 64347 | 64362 | TATATATGGTAGTCTA | 76 | 236 |
| 715576 | N/A | N/A | 79125 | 79140 | AACCTTTACCAAAACG | 80 | 237 |
| 715579 | N/A | N/A | 80917 | 80932 | CTGTCTGGAATACACA | 100 | 238 |
| 715582 | N/A | N/A | 80924 | 80939 | GTCAAGCCTGTCTGGA | 33 | 239 |
| 715585 | N/A | N/A | 80978 | 80993 | AAGGTCTGGAACAGAT | 73 | 240 |
| 715588 | N/A | N/A | 81084 | 81099 | AGCAGCTAACAGCTTG | 96 | 241 |
| 715591 | N/A | N/A | 81149 | 81164 | CTTTGGCAGAGATAAA | 41 | 242 |

TABLE 3-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715594 | N/A | N/A | 81155 | 81170 | ATATTTCTTTGGCAGA | 39 | 243 |
| 715597 | N/A | N/A | 98888 | 98903 | CTGGTTCATGGCTGAA | 89 | 244 |
| 715600 | N/A | N/A | 102399 | 102414 | AATTCCCAAGCTACCC | 82 | 245 |
| 715603 | N/A | N/A | 102405 | 102420 | GCACAGAATTCCCAAG | 106 | 246 |
| 715606 | N/A | N/A | 102411 | 102426 | ACCATAGCACAGAATT | 88 | 247 |
| 715609 | N/A | N/A | 102448 | 102463 | TGTGTAGGCTGACTTA | 56 | 248 |
| 715612 | N/A | N/A | 102471 | 102486 | TACTTTAAGCCACATG | 77 | 249 |
| 715615 | N/A | N/A | 102482 | 102497 | CGGATAAAAATTACTT | 94 | 250 |
| 715618 | N/A | N/A | 102488 | 102503 | ATAAGACGGATAAAAA | 101 | 251 |
| 715621 | N/A | N/A | 102494 | 102509 | TAAAAATAAGACGGA | 106 | 252 |
| 715624 | N/A | N/A | 102504 | 102519 | TGCCTAAGAGTAAAAA | 123 | 253 |
| 715627 | N/A | N/A | 102553 | 102568 | CTACCTGACATTTTGG | 88 | 254 |
| 715630 | N/A | N/A | 102559 | 102574 | AAGAGCCTACCTGACA | 94 | 255 |
| 715633 | N/A | N/A | 120466 | 120481 | GTGATAGGTGCCACTA | 78 | 256 |

Example 2

Antisense Inhibition of Human Yap1 in A-431 Cells by cEt Gapmers

Modified oligonucleotides were designed to target a Yap1 nucleic acid and were tested for their effect on Yap1 mRNA level in vitro. The modified oligonucleotides were tested in a series of experiments that had similar culture conditions. The results for each experiment are presented in separate tables shown below. Cultured A-431 cells at a density of 5,000 cells per well were treated using free uptake with 2,000 nM of modified oligonucleotide. After a treatment period of approximately 48 hours, RNA was isolated from the cells and Yap1 mRNA levels were measured by quantitative real-time RTPCR. Human primer probe set RTS4814 was used to measure mRNA levels. Yap1 mRNA levels were normalized to total RNA content, as measured by RIBOGREEN®. Results are presented in the tables below as percent control of the amount of Yap1 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Gapmers listed in the Tables below are targeted to either SEQ ID NO: 1, SEQ ID NO: 2, SEQ ID NO: 3 (GENBANK Accession No. NM_006106.4), or SEQ ID NO: 4 (GENBANK Accession No. NM_001130145.2). 'N/A' indicates that the modified oligonucleotide does not target that particular gene sequence with 100% complementarity. 'N.D.' indicates that the % UTC is not defined for that particular modified oligonucleotide in that particular experiment. Activity of the modified oligonucleotide may be defined in a different experiment.

TABLE 4

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716346 | 1 | 16 | 3461 | 3476 | TTTCCCTGGCGGCGGC | 77 | 257 |
| 716349 | 107 | 122 | 3567 | 3582 | ACTTTTTCCCTCCAAC | 78 | 258 |

TABLE 4-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716352 | 184 | 199 | 3644 | 3659 | CTGCGCCCCGGCTCCA | 105 | 259 |
| 716355 | 279 | 294 | 3739 | 3754 | GACGGCTGCGGGCCGG | 96 | 260 |
| 716358 | 331 | 346 | 3791 | 3806 | CGAGGGCTACGCCCGG | 104 | 261 |
| 716361 | 405 | 420 | 3865 | 3880 | GGTTGAGGCGGCGGCT | 75 | 262 |
| 716364 | 493 | 508 | 3953 | 3968 | CGCCGCGGGTGCCGGT | 110 | 263 |
| 716367 | 631 | 646 | 4091 | 4106 | CATGGGCACGGTCTGG | 70 | 264 |
| 716370 | 716 | 731 | 7150 | 7165 | CAGTGCCTGCATCAGT | 25 | 265 |
| 716373 | 775 | 790 | 7209 | 7224 | CAACTGCAGAGAAGCT | 69 | 266 |
| 716376 | 855 | 870 | 7289 | 7304 | CGAAGATGCTGAGCTG | 35 | 267 |
| 716379 | 927 | 942 | 7361 | 7376 | CCAGAAGATGTCTTTG | 123 | 268 |
| 716382 | 993 | 1008 | 55488 | 55503 | AGCATGGCCTTCCTGG | 73 | 269 |
| 716385 | 1084 | 1099 | 79025 | 79040 | TTCCCATCCATCAGGA | 87 | 270 |
| 716388 | 1144 | 1159 | 79085 | 79100 | AGAGGTGGTCTTGTTC | 55 | 271 |
| 716391 | 1206 | 1221 | 98908 | 98923 | GGAGCACTCTGACTGA | 44 | 272 |
| 716394 | 1304 | 1319 | 99006 | 99021 | GTTGCTGCAGTCGCAT | 120 | 273 |
| 716397 | 1365 | 1380 | 99067 | 99082 | GGCCTCACCTGCCGAA | 88 | 274 |
| 716400 | 1423 | 1438 | N/A | N/A | TAACTCCTGACATTTT | 106 | 275 |
| 716403 | 1491 | 1506 | 116680 | 116695 | CCGGGAGAAGACACTG | 110 | 276 |
| 716406 | 1576 | 1591 | 120481 | 120496 | ACTCTCATCTCGAGAG | 117 | 277 |
| 716409 | 1636 | 1651 | 120541 | 120556 | CAGGAAGTCATCTGGG | 99 | 278 |
| 716412 | 1717 | 1732 | 122742 | 122757 | GTAGTCTGGGAAACGG | 41 | 279 |
| 716415 | 1794 | 1809 | 122819 | 122834 | AGCTCCTCTCCTTCTA | 90 | 280 |
| 716418 | 1910 | 1925 | 122935 | 122950 | CCTGAGGGCTCTATAA | 75 | 281 |
| 716421 | 1996 | 2011 | 123021 | 123036 | TATTAGCCTGAAAACT | 86 | 282 |
| 716424 | 2064 | 2079 | 123089 | 123104 | GCAATGGACAAGGAAG | 25 | 283 |
| 716427 | 2170 | 2185 | 123195 | 123210 | AGCCCCCAAAATGAAC | 86 | 284 |
| 716430* | 2221 | 2236 | 123246 | 123261 | TAACTGGGCAAAGGA | 28 | 285 |
| 716433* | 2272 | 2287 | 123297 | 123312 | AGCATCTGACTTCTAA | 20 | 286 |
| 716436 | 2329 | 2344 | 123354 | 123369 | ACTGGACAAAGGAAGC | 59 | 287 |
| 716439 | 2387 | 2402 | 123412 | 123427 | GTATTTAATATCAGAT | 77 | 288 |
| 716442 | 2466 | 2481 | 123491 | 123506 | GCACTAGGAGGAAAAG | 63 | 289 |
| 716445 | 2559 | 2574 | 123584 | 123599 | GTATGTGGCAATAATT | 28 | 290 |
| 716448 | 2683 | 2698 | 123708 | 123723 | CCGACAAAACCAACCA | 62 | 291 |
| 716451 | 2734 | 2749 | 123759 | 123774 | CCCAAGCTACAACTAT | 67 | 292 |
| 716454 | 2803 | 2818 | 123828 | 123843 | CGAGATTTAAATAAGG | 27 | 293 |
| 716457 | 2883 | 2898 | 123908 | 123923 | AAAGGATACATTCCAC | 61 | 294 |

TABLE 4-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716460 | 2946 | 2961 | 123971 | 123986 | TATTCTAAATGCATAC | 86 | 295 |
| 716463 | 2998 | 3013 | 124023 | 124038 | GACTGCCCCAACCAGA | 64 | 296 |
| 716466 | 3071 | 3086 | 124096 | 124111 | GTGGAGCACTCCCCTA | 58 | 297 |
| 716469 | 3122 | 3137 | 124147 | 124162 | GTTTGCTCCTTTCCAA | 25 | 298 |
| 716472 | 3204 | 3219 | 124229 | 124244 | GTCATGCACATTATGA | 78 | 299 |
| 716475 | 3272 | 3287 | 124297 | 124312 | CTTCCAAAACTAAGGC | 63 | 300 |
| 716478 | 3330 | 3345 | 124355 | 124370 | TATTTTAATCTAGTCG | 46 | 301 |
| 716481 | 3382 | 3397 | 121835 124407 | 121850 124422 | TCAGCATAGAAGTAGG | 23 | 302 |
| 716484 | 3433 | 3448 | 124458 | 124473 | CACTTTTCCAGCTAAC | 35 | 303 |
| 716487 | 3541 | 3556 | 42912 124566 | 42927 124581 | ACACATACTCTAGTTA | 64 | 304 |
| 716490 | 3640 | 3655 | 124665 | 124680 | ACAACCAACTATTACT | 63 | 305 |
| 716493 | 3692 | 3707 | 124717 | 124732 | ACATTGAAAGACCCTT | 30 | 306 |
| 716496 | 3745 | 3760 | 124770 | 124785 | GAAGAGATTTTATGCC | 19 | 307 |
| 716499 | 3852 | 3867 | 124877 | 124892 | TTTTGCCCTCCTCCAA | 102 | 308 |
| 716502 | 3913 | 3928 | 124938 | 124953 | CACAGTGATTGCATTT | 11 | 309 |
| 716505 | 3996 | 4011 | 125021 | 125036 | GATTTAATCTTTCTGC | 35 | 310 |
| 716508 | 4065 | 4080 | 125090 | 125105 | CTAGGTAGAATTTCAT | 67 | 311 |
| 716511 | 4131 | 4146 | 125156 | 125171 | GATCTTCTGCACATTA | 51 | 312 |
| 716514 | 4201 | 4216 | 125226 | 125241 | GCTGATATATAAGATA | 68 | 313 |
| 716517 | 4255 | 4270 | 125280 | 125295 | TTCACAACCCCCCCCC | 53 | 314 |
| 716520 | 4312 | 4327 | 125337 | 125352 | AGTCTTTATTAAAGAG | 96 | 315 |
| 716523 | 4426 | 4441 | 125451 | 125466 | CAAATTAAAGTTGAGG | 37 | 316 |
| 716526 | 4481 | 4496 | 125506 | 125521 | TCAAAGCACTGTGCCA | 88 | 317 |
| 716529 | 4544 | 4559 | 125569 | 125584 | CAAACTCAAAAAGGGA | 61 | 318 |
| 716532 | 4615 | 4630 | 125640 | 125655 | CAAGAAGCAGTTAAGC | 70 | 319 |
| 716535 | 4737 | 4752 | 125762 | 125777 | CCTGACTGAAAATAAC | 86 | 320 |
| 716538 | 4789 | 4804 | 125814 | 125829 | TCTGAAACTCCAAATC | 77 | 321 |
| 716541 | 4840 | 4855 | 125865 | 125880 | TAAAGGCACTACATTT | 92 | 322 |
| 716544 | 4898 | 4913 | 125923 | 125938 | TACTTAACACAGCAAC | 71 | 323 |
| 716547 | 4986 | 5001 | 44309 126011 | 44324 126026 | GGTATGAATTCTGAAT | 44 | 324 |
| 716550 | 5037 | 5052 | 126062 | 126077 | GCACTGAATATTGCCA | 77 | 325 |
| 716553 | 5088 | 5103 | 126113 | 126128 | ATCCACCTGAGCACTC | 54 | 326 |
| 716556 | 5211 | 5226 | 126236 | 126251 | GCATTAAAGAATTCTC | 39 | 327 |
| 716559 | 5294 | 5309 | 126319 | 126334 | CCTAACATATGAGCAT | 62 | 328 |
| 716565 | N/A | N/A | 5516 | 5531 | GGGCTAACTACATTGC | 129 | 329 |

TABLE 4-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716568 | N/A | N/A | 5640 | 5655 | GATTTTTCTGAGTTC | 72 | 330 |
| 716574 | N/A | N/A | 11831 11769 | 11846 11784 | TACACTGTATATGTT | 91 | 331 |
| 716577 | N/A | N/A | 58766 58782 | 58781 58797 | TCTGTCAGTTATCCTA | 21 | 332 |

TABLE 5

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716347 | 64 | 79 | 3524 | 3539 | TGCCTTTCCCCGCCTC | 85 | 333 |
| 716350 | 129 | 144 | 3589 | 3604 | CTCGGACCTGCGGCGC | 99 | 334 |
| 716353 | 216 | 231 | 3676 | 3691 | GCATCCCCGCCCCGG | 98 | 335 |
| 716356 | 296 | 311 | 3756 | 3771 | CGAGGTGGAGAAGCGG | 112 | 336 |
| 716359 | 348 | 363 | 3808 | 3823 | CCCCTGACCCAGGCGA | 101 | 337 |
| 716362 | 433 | 448 | 3893 | 3908 | AGGCGGCTGCCCTTGG | 94 | 338 |
| 716365 | 533 | 548 | 3993 | 4008 | TCTGATGCCCGGCGGG | 83 | 339 |
| 716368 | 652 | 667 | 4112 | 4127 | GTCGGGCAGCTTCCGG | 86 | 340 |
| 716371 | 733 | 748 | 7167 | 7182 | TGGAGTCAGGGCTCCT | 115 | 341 |
| 716374 | 802 | 817 | 7236 | 7251 | GGTCAGTGTCCCAGGA | 54 | 342 |
| 716377 | 876 | 891 | 7310 | 7325 | GGTATCTCAAAAGAAG | 76 | 343 |
| 716380 | 944 | 959 | 7378 | 7393 | TTAAGAAGTATCTCTG | 54 | 344 |
| 716383 | 1049 | 1064 | 55544 | 55559 | TCATCATATTCTGCTG | 98 | 345 |
| 716386 | 1110 | 1125 | 79051 | 79066 | ATTTCTCCATCCTGAG | 60 | 346 |
| 716389 | 1161 | 1176 | 79102 | 79117 | AGCCTTGGGTCTAGCC | 93 | 347 |
| 716392 | 1266 | 1281 | 98968 | 98983 | CTGCCACCCATGACGC | 95 | 348 |
| 716395 | 1331 | 1346 | 99033 | 99048 | GCCGCAGCCTCTCCTT | 92 | 349 |
| 716398 | 1382 | 1397 | N/A | N/A | TATTCCGCATTGCCTG | 70 | 350 |
| 716401 | 1440 | 1455 | 116629 | 116644 | AACTGGCTACGCAGGG | 92 | 351 |
| 716404 | 1519 | 1534 | 116708 | 116723 | CGTCATTGTTCTCAAT | 63 | 352 |
| 716407 | 1593 | 1608 | 120498 | 120513 | CTTAGTCCACTGTCTG | 35 | 353 |
| 716410 | 1668 | 1683 | N/A | N/A | GTATCACCTGTATCCA | 52 | 354 |
| 716413 | 1753 | 1768 | 122778 | 122793 | TCCAAGGTCCACATTT | 79 | 355 |
| 716416 | 1834 | 1849 | 122859 | 122874 | AAGGATGTCAGAACTC | 45 | 356 |
| 716419 | 1962 | 1977 | 122987 | 123002 | TTTCCGGTGCATGTGT | 36 | 357 |
| 716422 | 2030 | 2045 | 123055 | 123070 | AGTATCTTGCTGGACG | 39 | 358 |
| 716425 | 2081 | 2096 | 123106 | 123121 | GCAATACATTAACAGC | 71 | 359 |

TABLE 5-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716428* | 2187 | 2202 | 123212 | 123227 | ACAGGCTCACTTCCCC | 10 | 360 |
| 716431* | 2238 | 2253 | 123263 | 123278 | AATGATTGGTGAACAT | 55 | 361 |
| 716434* | 2289 | 2304 | 123314 | 123329 | TAAATGCTGTGACATG | 44 | 362 |
| 716437 | 2349 | 2364 | 123374 | 123389 | CCAGTAAATCATGTTT | 41 | 363 |
| 716440 | 2406 | 2421 | 123431 | 123446 | CTCTTCAAATCAGCAT | 45 | 364 |
| 716443 | 2483 | 2498 | 123508 | 123523 | TTATGTGACTAATGAT | 73 | 365 |
| 716446 | 2597 | 2612 | 123622 | 123637 | GCACACCCACAAAATT | 83 | 366 |
| 716449 | 2700 | 2715 | 123725 | 123740 | GGTCATTTGCCTAGGT | 49 | 367 |
| 716452 | 2759 | 2774 | 123784 | 123799 | TTACCAAAACAACTAC | 98 | 368 |
| 716455 | 2849 | 2864 | 123874 | 123889 | GTTATGTTTGGGTGTG | 17 | 369 |
| 716458 | 2900 | 2915 | 123925 | 123940 | AAGCAGGGAAACCTAA | 94 | 370 |
| 716461 | 2963 | 2978 | 123988 | 124003 | ATAAACTACTAGTCAT | 123 | 371 |
| 716464 | 3015 | 3030 | 124040 | 124055 | TACTTCAAACATCTGC | 62 | 372 |
| 716467 | 3088 | 3103 | 124113 | 124128 | CCGTATGCCCAGAGGG | 99 | 373 |
| 716470 | 3170 | 3185 | 124195 | 124210 | AATCGAGACTTAAAAA | 104 | 374 |
| 716473 | 3221 | 3236 | 124246 | 124261 | CTATAAAGCTTATTTC | 104 | 375 |
| 716476 | 3292 | 3307 | 124317 | 124332 | GAACTACAAACTAGAA | 91 | 376 |
| 716479 | 3348 | 3363 | 124373 | 124388 | GAACAATCTTGAAGGC | 32 | 377 |
| 716482 | 3399 | 3414 | 124424 | 124439 | CTATCCAGGGTCAATT | 83 | 378 |
| 716485 | 3461 | 3476 | 124486 | 124501 | ACTACCAATATACATT | 84 | 379 |
| 716488 | 3558 | 3573 | 38751 124583 | 38766 124598 | CATTATTACTCCTGTA | 67 | 380 |
| 716491 | 3658 | 3673 | 124683 | 124698 | CTGGTGCCACTTTAAT | 54 | 381 |
| 716494 | 3709 | 3724 | 124734 | 124749 | AAGGGCTTATTCTAGA | 112 | 382 |
| 716497 | 3762 | 3777 | 124787 | 124802 | AGCAGCTTTTGCCAGG | 65 | 383 |
| 716500 | 3869 | 3884 | 124894 | 124909 | AACTTCTTACTTCCAA | 18 | 384 |
| 716503 | 3951 | 3966 | 124976 | 124991 | TTATTATGAGTGATCA | 33 | 385 |
| 716506 | 4031 | 4046 | 125056 | 125071 | TCTGCAGTGGCCATTT | 62 | 386 |
| 716509 | 4083 | 4098 | 125108 | 125123 | TATACCCAATTTTGCA | 70 | 387 |
| 716512 | 4150 | 4165 | 125175 | 125190 | ACTCCTTCCAAGTAGC | 99 | 388 |
| 716515 | 4218 | 4233 | 125243 | 125258 | TAAGCTAAAGCTAATC | 123 | 389 |
| 716518 | 4272 | 4287 | 125297 | 125312 | CAAGGTCCCCCTAAAT | 88 | 390 |
| 716521 | 4329 | 4344 | 125354 | 125369 | CAGCACGGTGTAAGAC | 79 | 391 |
| 716524 | 4443 | 4458 | 125468 | 125483 | ACTGAGGTATAACTGG | 35 | 392 |
| 716527 | 4502 | 4517 | 125527 | 125542 | AGTACAGAGGGCATCG | 64 | 393 |
| 716530 | 4561 | 4576 | 125586 | 125601 | ACATCAAGGCTATGAT | 83 | 394 |
| 716533 | 4666 | 4681 | 125691 | 125706 | CAATTCAAGAATACCC | 64 | 395 |

TABLE 5-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716536 | 4754 | 4769 | 125779 | 125794 | AAGTAGATCTAAGAAG | 94 | 396 |
| 716539 | 4806 | 4821 | 125831 | 125846 | AATAGTGCTTTGGAAG | 59 | 397 |
| 716542 | 4863 | 4878 | 125888 | 125903 | CTTCCCTGTGTTCATT | 45 | 398 |
| 716545 | 4916 | 4931 | 125941 | 125956 | GCATGTATTTAATATG | 91 | 399 |
| 716548 | 5003 | 5018 | 126028 | 126043 | GAGTTTCAACACTGAT | 31 | 400 |
| 716551 | 5054 | 5069 | 126079 | 126094 | CGCTAGAAAAGTGTTA | 76 | 401 |
| 716554 | 5105 | 5120 | 126130 | 126145 | ATGCTTGCGAGGATAA | 30 | 402 |
| 716557 | 5243 | 5258 | 126268 | 126283 | ATTGGTACTATATATA | 80 | 403 |
| 716560 | 5312 | 5327 | 126337 | 126352 | TAACAATTTATGTAAG | 107 | 404 |
| 716563 | N/A | N/A | 5445 | 5460 | TGAAGCAAGTTCTCAA | 126 | 405 |
| 716566 | N/A | N/A | 5552 | 5567 | GGTAACTCTTCTTTCC | 102 | 406 |
| 716569 | N/A | N/A | 5674 | 5689 | CTCCTTAACCCGGGTT | 115 | 407 |
| 716572 | N/A | N/A | 126465 | 126480 | CAGTAAGAAGCCAAAA | 122 | 408 |
| 716575 | N/A | N/A | 30867 31189 | 30882 31204 | AAAGAACTTAGTTCCC | 84 | 409 |
| 716578 | N/A | N/A | 70445 70695 | 70460 70710 | AACTTTCACATAAACT | 102 | 410 |

TABLE 6

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716348 | 84 | 99 | 3544 | 3559 | ACGGAGGCCGGACAGC | 107 | 411 |
| 716351 | 166 | 181 | 3626 | 3641 | GGTCTGGCGGCTGCGC | 112 | 412 |
| 716354 | 251 | 266 | 3711 | 3726 | TCGCTCTCAGGGCCGG | 114 | 413 |
| 716357 | 314 | 329 | 3774 | 3789 | CGCCCCGGCTCCACGG | 127 | 414 |
| 716360 | 388 | 403 | 3848 | 3863 | CTGCCCGGGATCCATG | 118 | 415 |
| 716363 | 467 | 482 | 3927 | 3942 | CGGACGGCGGGCCCTG | 103 | 416 |
| 716366 | 568 | 583 | 4028 | 4043 | CAGGTCGGTCTCCGAG | 95 | 417 |
| 716369 | 670 | 685 | 4130 | 4145 | CGGCGGCTTGAAGAAG | 94 | 418 |
| 716372 | 751 | 766 | 7185 | 7200 | ATGAGCTCGAACATGC | 61 | 419 |
| 716375 | 819 | 834 | 7253 | 7268 | GAGACTACTCCAGTGG | 63 | 420 |
| 716378 | 893 | 908 | 7327 | 7342 | GCAGAGGTACATCATC | 44 | 421 |
| 716381 | 961 | 976 | 55456 | 55471 | TGTCTGATCGATGTGA | 35 | 422 |
| 716384 | 1066 | 1081 | N/A | N/A | AGGACCTGAAGCCGAG | 71 | 423 |
| 716387 | 1127 | 1142 | 79068 | 79083 | TATGGTTTATATAGTA | 33 | 424 |

TABLE 6-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716390 | 1189 | 1204 | N/A | N/A | TCTCTGGTTCATGGCA | 66 | 425 |
| 716393 | 1285 | 1300 | 98987 | 99002 | TTGCTGCTGGTTGGAG | 46 | 426 |
| 716396 | 1348 | 1363 | 99050 | 99065 | CAGTTCTTGCTGTTTC | 123 | 427 |
| 716399 | 1403 | 1418 | 102535 | 102550 | AATTTGCTGTGCTGGG | 40 | 428 |
| 716402 | 1474 | 1489 | 116663 | 116678 | ATTTTGAGTCCCACCA | 85 | 429 |
| 716405 | 1547 | 1562 | 116736 | 116751 | TGTTAAGGAAAGGATC | 149 | 430 |
| 716408 | 1610 | 1625 | 120515 | 120530 | CACTGTAGCTGCTCAT | 54 | 431 |
| 716411 | 1700 | 1715 | 122725 | 122740 | TCTGCTGTGAGGGCAG | 102 | 432 |
| 716414 | 1777 | 1792 | 122802 | 122817 | GTTCATTCCATCTCCT | 59 | 433 |
| 716417 | 1891 | 1906 | 122916 | 122931 | TGTAAGAAAGCTTTCT | 78 | 434 |
| 716420 | 1979 | 1994 | 24076 123004 | 24091 123019 | CAACTGGCTTATGGAA | 50 | 435 |
| 716423 | 2047 | 2062 | 71297 123072 | 71312 123087 | GCAAAATAGAGGATTA | 43 | 436 |
| 716426 | 2115 | 2130 | 123140 | 123155 | TTTGATTCTTTAGAGC | 45 | 437 |
| 716429* | 2204 | 2219 | 123229 | 123244 | TGGCATCCATCATCCA | 28 | 438 |
| 716432* | 2255 | 2270 | 123280 | 123295 | TCTGAGTATTTAGTTA | 30 | 439 |
| 716435* | 2306 | 2321 | 123331 | 123346 | ACAACTGTTGAACAAA | 45 | 440 |
| 716438 | 2366 | 2381 | 123391 | 123406 | ATTTTTGGCTTGTCAG | 32 | 441 |
| 716441 | 2423 | 2438 | 123448 | 123463 | GCCTTGGTTTCAGCTA | 57 | 442 |
| 716444 | 2528 | 2543 | 123553 | 123568 | AAATTGTCTCATGCCT | 40 | 443 |
| 716447 | 2666 | 2681 | 123691 | 123706 | CCAACCAACCCCCCCA | 97 | 444 |
| 716450 | 2717 | 2732 | 123742 | 123757 | AACAGATTCACTAATA | 83 | 445 |
| 716453 | 2786 | 2801 | 123811 | 123826 | GGTAAAAAAAACCAGG | 87 | 446 |
| 716456 | 2866 | 2881 | 123891 | 123906 | ACCACACTATTATAAA | 96 | 447 |
| 716459 | 2926 | 2941 | 123951 | 123966 | CGCTACCATTTTAAAA | 121 | 448 |
| 716462 | 2981 | 2996 | 124006 | 124021 | TTAAACTACCAGTGAA | 86 | 449 |
| 716465 | 3036 | 3051 | 124061 | 124076 | GCTCTTTCTAGAACAC | 82 | 450 |
| 716468 | 3105 | 3120 | 124130 | 124145 | TCATCAGATAATATCT | 118 | 451 |
| 716471 | 3187 | 3202 | 124212 | 124227 | CCTACTCACTGAATTC | 48 | 452 |
| 716474 | 3238 | 3253 | 124263 | 124278 | TAAATGAAGGTAAACC | 120 | 453 |
| 716477 | 3309 | 3324 | 124334 | 124349 | GTGTTCATTACAAATG | 42 | 454 |
| 716480 | 3365 | 3380 | 124390 | 124405 | GCAAGTCTTGTAAGTA | 18 | 455 |
| 716483 | 3416 | 3431 | 15582 82739 124441 | 15597 82754 124456 | CAAAACCTTATAGTAT | 159 | 456 |
| 716486 | 3494 | 3509 | 124519 | 124534 | ATCATGATTATCTCTA | 68 | 457 |
| 716489 | 3606 | 3621 | 124631 | 124646 | AGTTAATTCATGCTCG | 23 | 458 |
| 716492 | 3675 | 3690 | 124700 | 124715 | AAACACAGAGGTGCTA | 72 | 459 |

TABLE 6-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 716495 | 3728 | 3743 | 124753 | 124768 | GTTATGAACCCTTGAA | 58 | 460 |
| 716498 | 3833 | 3848 | 124858 | 124873 | GAAGGGCCAAAATACT | 92 | 461 |
| 716501 | 3891 | 3906 | 124916 | 124931 | GCACTGAAAGTACTTA | 32 | 462 |
| 716504 | 3970 | 3985 | 6107 | 6122 | ATAAAAGCCTTAGAGT | 112 | 463 |
|  |  |  | 62583 | 62598 |  |  |  |
|  |  |  | 124995 | 125010 |  |  |  |
| 716507 | 4048 | 4063 | 125073 | 125088 | ACTACTCTAAAACTCC | 53 | 464 |
| 716510 | 4102 | 4117 | 125127 | 125142 | CAACATGCTATGTAAT | 122 | 465 |
| 716513 | 4184 | 4199 | 125209 | 125224 | AATCTTAATCTGTGGC | 30 | 466 |
| 716516 | 4237 | 4252 | 125262 | 125277 | AACTTTCCCACCCTCC | 84 | 467 |
| 716519 | 4290 | 4305 | 125315 | 125330 | GTTTATAAAGTTCTCT | 57 | 468 |
| 716522 | 4363 | 4378 | 125388 | 125403 | GTGACTGAAACTCTAG | 47 | 469 |
| 716525 | 4460 | 4475 | 125485 | 125500 | CACAGTACTGCTACAA | 64 | 470 |
| 716528 | 4520 | 4535 | 125545 | 125560 | TTAGGTCTCCTTCAGG | 70 | 471 |
| 716531 | 4580 | 4595 | 125605 | 125620 | GGACATAAAACAAGAG | 65 | 472 |
| 716534 | 4693 | 4708 | 125718 | 125733 | GATTATAAAATTGGTT | 90 | 473 |
| 716537 | 4772 | 4787 | 125797 | 125812 | ATGTGCTCCATCAACC | 36 | 474 |
| 716540 | 4823 | 4838 | 125848 | 125863 | GAAAGTTATTACAAC | 120 | 475 |
| 716543 | 4880 | 4895 | 125905 | 125920 | TATTTGTAGCAAAGTC | 35 | 476 |
| 716546 | 4968 | 4983 | 125993 | 126008 | CACAATTAATTACTGT | 103 | 477 |
| 716549 | 5020 | 5035 | 126045 | 126060 | CCACTTTTGCAATGTT | 44 | 478 |
| 716552 | 5071 | 5086 | 126096 | 126111 | TTTCTCAGATGTACCA | 53 | 479 |
| 716555 | 5167 | 5182 | 126192 | 126207 | TACTTTTTCAAGATAC | 99 | 480 |
| 716558 | 5277 | 5292 | 126302 | 126317 | CTCTTACATCTAAAAC | 81 | 481 |
| 716561 | 5338 | 5353 | 126363 | 126378 | AAGGTATTACATAAGA | 58 | 482 |
| 716564 | N/A | N/A | 5479 | 5494 | CTTTTGGGCAAAGTTC | 103 | 483 |
| 716567 | N/A | N/A | 5599 | 5614 | GACTATACAACAGGCC | 134 | 484 |
| 716570 | N/A | N/A | 5717 | 5732 | AAGTGTTTAGGCAAGC | 56 | 485 |
| 716573 | N/A | N/A | 126516 | 126531 | AGTTACTACTGTAATC | 116 | 486 |
| 716576 | N/A | N/A | 58764 | 58779 | TGTCAGTTATCCTATC | 52 | 487 |
|  |  |  | 58780 | 58795 |  |  |  |
| 716579 | N/A | N/A | 94212 | 94227 | ATAGAGATTTTCCCTC | 84 | 488 |
|  |  |  | 103505 | 103520 |  |  |  |

TABLE 7

Inhibition of Yap1 nRNA by 3-10-3 cEt gapmers targeting SEQ ID NO: 3, and 4

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | YAP1 (% UTC) | SEQ ID NO |
|---|---|---|---|---|---|---|---|
| 716562 | N/A | N/A | 1359 | 1374 | GCCTGCCGAAGCAGTT | 103 | 489 |
| 716571 | 1062 | 1077 | N/A | N/A | GCTGAAGCCGAGTTCA | 91 | 490 |

Example 3

Antisense Inhibition of Human Yap1 in A-431 Cells by cEt Gapmers

Modified oligonucleotides were designed to target a Yap1 nucleic acid and were tested for their effect on Yap1 mRNA level in vitro. The modified oligonucleotides were tested in a series of experiments that had similar culture conditions. The results for each experiment are presented in separate tables shown below. Cultured A-431 cells at a density of 5,000 cells per well were treated using free uptake with 2,000 nM of modified oligonucleotide. After a treatment period of approximately 48 hours, RNA was isolated from the cells and Yap1 mRNA levels were measured by quantitative real-time RTPCR. Human primer probe set RTS36584 (forward sequence ACGACCAATAGCTCA-GATCCT, designated herein as SEQ ID NO.: 14; reverse sequence CACCTGTATCCATCTCATCCAC, designated herein as SEQ ID NO.: 15; probe sequence TGTAGCTGCT-CATGCTTAGTCCACTG, designated herein as SEQ ID NO.: 16) was used to measure mRNA levels. Yap1 mRNA levels were normalized to total RNA content, as measured by RIBOGREEN®. Results are presented in the tables below as percent control of the amount of Yap1 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1 or SEQ ID NO.: 2. 'N/A' indicates that the modified oligonucleotide does not target that particular gene sequence with 100% complementarity. 'N.D.' indicates that the % UTC is not defined for that particular modified oligonucleotide in that particular experiment. Activity of the modified oligonucleotide may be defined in a different experiment.

TABLE 8

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 2 | 206 |
| 715491 | 3638 | 3653 | 124663 | 124678 | AACCAACTATTACTTC | 8 | 131 |
| 958348 | 556 | 571 | 4016 | 4031 | CGAGTCCCCGCGGACG | 122 | 491 |
| 958349 | 557 | 572 | 4017 | 4032 | CCGAGTCCCCGCGGAC | 81 | 492 |
| 958350 | 558 | 573 | 4018 | 4033 | TCCGAGTCCCCGCGGA | 106 | 493 |
| 958351 | 560 | 575 | 4020 | 4035 | TCTCCGAGTCCCCGCG | 67 | 494 |
| 958352 | 563 | 578 | 4023 | 4038 | CGGTCTCCGAGTCCCC | 110 | 495 |
| 958353 | 564 | 579 | 4024 | 4039 | TCGGTCTCCGAGTCCC | 43 | 496 |
| 958354 | 565 | 580 | 4025 | 4040 | GTCGGTCTCCGAGTCC | 31 | 497 |
| 958355 | 611 | 626 | 4071 | 4086 | CGTTGGCCGTCTTGGG | 51 | 498 |
| 958356 | 663 | 678 | 4123 | 4138 | TTGAAGAAGGAGTCGG | 9 | 499 |

TABLE 8-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958357 | 667 | 682 | 4127 | 4142 | CGGCTTGAAGAAGGAG | 12 | 500 |
| 958358 | 669 | 684 | 4129 | 4144 | GGCGGCTTGAAGAAGG | 34 | 501 |
| 958359 | 709 | 724 | 7143 | 7158 | TGCATCAGTACTGGCC | 117 | 502 |
| 958360 | 745 | 760 | 7179 | 7194 | TCGAACATGCTGTGGA | 12 | 503 |
| 958361 | 747 | 762 | 7181 | 7196 | GCTCGAACATGCTGTG | 8 | 504 |
| 958362 | 748 | 763 | 7182 | 7197 | AGCTCGAACATGCTGT | 58 | 505 |
| 958363 | 750 | 765 | 7184 | 7199 | TGAGCTCGAACATGCT | 70 | 506 |
| 958364 | 969 | 984 | 55464 | 55479 | CATGTTGTTGTCTGAT | 19 | 507 |
| 958365 | 971 | 986 | 55466 | 55481 | GCCATGTTGTTGTCTG | 34 | 508 |
| 958366 | 1607 | 1622 | 120512 | 120527 | TGTAGCTGCTCATGCT | 16* | 509 |
| 958367 | 1871 | 1886 | 122896 | 122911 | CTAGCTTGGTGGCAGC | 105 | 510 |
| 958368 | 1873 | 1888 | 122898 | 122913 | ATCTAGCTTGGTGGCA | 11 | 511 |
| 958369 | 1875 | 1890 | 122900 | 122915 | TTATCTAGCTTGGTGG | 4 | 512 |
| 958370 | 1877 | 1892 | 122902 | 122917 | CTTTATCTAGCTTGGT | 7 | 513 |
| 958371 | 3637 | 3652 | 124662 | 124677 | ACCAACTATTACTTCA | 2 | 514 |
| 958372 | 3666 | 3681 | 124691 | 124706 | GGTGCTAGCTGGTGCC | 49 | 515 |
| 958373 | 3667 | 3682 | 124692 | 124707 | AGGTGCTAGCTGGTGC | 8 | 516 |
| 958374 | 3670 | 3685 | 124695 | 124710 | CAGAGGTGCTAGCTGG | 38 | 517 |
| 958375 | 3967 | 3982 | 11044 124992 | 11059 125007 | AAAGCCTTAGAGTCAA | 2 | 518 |
| 958376 | 1392 | 1407 | 102524 | 102539 | CTGGGATTGATATTCC | 31 | 519 |
| 958377 | 1393 | 1408 | 102525 | 102540 | GCTGGGATTGATATTC | 9 | 520 |
| 958378 | N/A | N/A | 7141 | 7156 | CATCAGTACTGGCCTA | 25 | 521 |
| 958379 | N/A | N/A | 3336 | 3351 | GCGCCCGCCCGCACCG | 124 | 522 |
| 958380 | N/A | N/A | 3337 | 3352 | CGCGCCCGCCCGCACC | 106 | 523 |
| 958381 | N/A | N/A | 3344 | 3359 | TCCTCTGCGCGCCCGC | 146 | 524 |
| 958382 | N/A | N/A | 3345 | 3360 | TTCCTCTGCGCGCCCG | 111 | 525 |
| 958383 | N/A | N/A | 3346 | 3361 | CTTCCTCTGCGCGCCC | 96 | 526 |
| 958384 | N/A | N/A | 3347 | 3362 | CCTTCCTCTGCGCGCC | 131 | 527 |
| 958385 | N/A | N/A | 4548 | 4563 | GCGCGCGCATTGTGCA | 115 | 528 |
| 958386 | N/A | N/A | 4549 | 4564 | GGCGCGCGCATTGTGC | 111 | 529 |
| 958387 | N/A | N/A | 4551 | 4566 | GAGGCGCGCGCATTGT | 131 | 530 |
| 958388 | N/A | N/A | 4552 | 4567 | GGAGGCGCGCGCATTG | 112 | 531 |
| 958389 | N/A | N/A | 4553 | 4568 | CGGAGGCGCGCGCATT | 126 | 532 |
| 958390 | N/A | N/A | 4571 | 4586 | GCGAAGGTGCGGAGCG | 145 | 533 |
| 958391 | N/A | N/A | 4572 | 4587 | AGCGAAGGTGCGGAGC | 102 | 534 |
| 958392 | N/A | N/A | 5148 | 5163 | CTATGAGTCAACCTGC | 50 | 535 |

TABLE 8-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958393 | N/A | N/A | 5150 | 5165 | GCCTATGAGTCAACCT | 89 | 536 |
| 958394 | N/A | N/A | 8647 | 8662 | TTGAAACCTGATCCTT | 54 | 537 |
| 958395 | N/A | N/A | 8821 | 8836 | CTAACAACCTGGTTTG | 114 | 538 |
| 958396 | N/A | N/A | 8909 | 8924 | AGGCTATTAAGCTGTT | 131 | 539 |
| 958397 | N/A | N/A | 8910 | 8925 | CAGGCTATTAAGCTGT | 127 | 540 |
| 958398 | N/A | N/A | 8911 | 8926 | GCAGGCTATTAAGCTG | 76 | 541 |
| 958399 | N/A | N/A | 10927 | 10942 | GACCAACTACTTGAAG | 45 | 542 |
| 958400 | N/A | N/A | 10929 | 10944 | TTGACCAACTACTTGA | 26 | 543 |
| 958401 | N/A | N/A | 10964 | 10979 | AGTTATTCAGCAGCTT | 19 | 544 |
| 958402 | N/A | N/A | 29057 | 29072 | CTCTTACACAGCCTAG | 28 | 545 |
| 958403 | N/A | N/A | 36596 | 36611 | CAGTTTATGTAGTAGT | 5 | 546 |
| 958404 | N/A | N/A | 37602 | 37617 | GCACACAACTCAGACA | 52 | 547 |
| 958405 | N/A | N/A | 44925 | 44940 | TTATGGGATGAGTGCT | 24 | 548 |
| 958406 | N/A | N/A | 55773 | 55788 | TTTCAGTTATCGGCCC | 29 | 549 |
| 958407 | N/A | N/A | 63319 | 63334 | AATACTGATCTGCAGC | 35 | 550 |
| 958408 | N/A | N/A | 64348 | 64363 | CTATATATGGTAGTCT | 20 | 551 |
| 958409 | N/A | N/A | 79120 | 79135 | TTACCAAAACGAGGGT | 99 | 552 |
| 958410 | N/A | N/A | 79121 | 79136 | TTTACCAAAACGAGGG | 70 | 553 |
| 958411 | N/A | N/A | 79122 | 79137 | CTTTACCAAAACGAGG | 90 | 554 |
| 958412 | N/A | N/A | 79124 | 79139 | ACCTTTACCAAAACGA | 49 | 555 |
| 958413 | N/A | N/A | 90343 | 90358 | CTAGTAATCTTACTGG | 80 | 556 |
| 958414 | N/A | N/A | 102402 | 102417 | CAGAATTCCCAAGCTA | 73 | 557 |
| 958415 | N/A | N/A | 102449 | 102464 | CTGTGTAGGCTGACTT | 16 | 558 |
| 958416 | N/A | N/A | 102450 | 102465 | GCTGTGTAGGCTGACT | 36 | 559 |
| 958417 | N/A | N/A | 102483 | 102498 | ACGGATAAAAATTACT | 85 | 560 |
| 958418 | N/A | N/A | 102558 | 102573 | AGAGCCTACCTGACAT | 47 | 561 |
| 958419 | N/A | N/A | 102560 | 102575 | TAAGAGCCTACCTGAC | 68 | 562 |
| 958420 | N/A | N/A | 109095 | 109110 | TTCATAATCTGACTAG | 66 | 563 |
| 958421 | N/A | N/A | 112417 | 112432 | CTCCGTGGTGATCCCA | 13 | 564 |
| 958422 | N/A | N/A | 115003 | 115018 | TTTCTTAACCAGCGGA | 15 | 565 |
| 958423 | N/A | N/A | 121122 | 121137 | GATCAACATGCTAACA | 51 | 566 |

TABLE 9

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 1 | 206 |
| 958436 | 91 | 106 | 3551 | 3566 | TCCCTTGACGGAGGCC | 124 | 567 |
| 958441 | 281 | 296 | 3741 | 3756 | GCGACGGCTGCGGGCC | 72 | 568 |
| 958446 | 346 | 361 | 3806 | 3821 | CCTGACCCAGGCGAGC | 70 | 569 |
| 958451 | 538 | 553 | 3998 | 4013 | CACGATCTGATGCCCG | 10 | 570 |
| 958456 | 824 | 839 | 7258 | 7273 | GGCCAGAGACTACTCC | 90 | 571 |
| 958461 | 1355 | 1370 | 99057 | 99072 | GCCGAAGCAGTTCTTG | 79 | 572 |
| 958466 | 1840 | 1855 | 122865 | 122880 | GTCATTAAGGATGTCA | 9 | 573 |
| 958471 | 1943 | 1958 | 122968 | 122983 | CTTAGATCCTTCACAG | 14 | 574 |
| 958476 | 1961 | 1976 | 122986 | 123001 | TTCCGGTGCATGTGTC | 2 | 575 |
| 958481 | 1980 | 1995 | 123005 | 123020 | GCAACTGGCTTATGGA | 6 | 576 |
| 958486 | 2106 | 2121 | 123131 | 123146 | TTAGAGCCAACTGTGA | 9 | 577 |
| 958491 | 2291 | 2306 | 123316 | 123331 | ACTAAATGCTGTGACA | 4 | 578 |
| 958496 | 2515 | 2530 | 123540 | 123555 | CCTTATAAGCTCCTAA | 3 | 579 |
| 958501 | 2693 | 2708 | 123718 | 123733 | TGCCTAGGTTCCGACA | 41 | 580 |
| 958506 | 2812 | 2827 | 123837 | 123852 | GCAGATAATCGAGATT | 6 | 581 |
| 958511 | 2870 | 2885 | 123895 | 123910 | CACTACCACACTATTA | 31 | 582 |
| 958516 | 3003 | 3018 | 124028 | 124043 | CTGCAGACTGCCCCAA | 38 | 583 |
| 958521 | 3112 | 3127 | 124137 | 124152 | TTCCAATTCATCAGAT | 14 | 584 |
| 958526 | 3353 | 3368 | 124378 | 124393 | AGTAAGAACAATCTTG | 6 | 585 |
| 958531 | 3371 | 3386 | 124396 | 124411 | GTAGGAGCAAGTCTTG | 5 | 586 |
| 958536 | 3393 | 3408 | 124418 | 124433 | AGGGTCAATTTTCAGC | 3 | 587 |
| 958541 | 3404 | 3419 | 124429 | 124444 | GTATTCTATCCAGGGT | 4 | 588 |
| 958546 | 3538 | 3553 | 124563 | 124578 | CATACTCTAGTTACAT | 6 | 589 |
| 958551 | 3550 | 3565 | 124575 | 124590 | CTCCTGTAGACACATA | 5 | 590 |
| 958556 | 3639 | 3654 | 124664 | 124679 | CAACCAACTATTACTT | 10 | 591 |
| 958561 | 3673 | 3688 | 124698 | 124713 | ACACAGAGGTGCTAGC | 48 | 592 |
| 958566 | 3935 | 3950 | 124960 | 124975 | ACCTATGAACTATTAT | 18 | 593 |
| 958571 | 4105 | 4120 | 125130 | 125145 | CAACAACATGCTATGT | 43 | 594 |
| 958576 | 4173 | 4188 | 125198 | 125213 | GTGGCTACTGGCAAAT | 53 | 595 |
| 958581 | 4203 | 4218 | 125228 | 125243 | CTGCTGATATATAAGA | 26 | 596 |
| 958586 | 4331 | 4346 | 125356 | 125371 | GGCAGCACGGTGTAAG | 78 | 597 |
| 958591 | 4461 | 4476 | 125486 | 125501 | TCACAGTACTGCTACA | 38 | 598 |
| 958596 | 4610 | 4625 | 125635 | 125650 | AGCAGTTAAGCACTTT | 3 | 599 |
| 958601 | 4844 | 4859 | 125869 | 125884 | CCTTTAAAGGCACTAC | 17 | 600 |
| 958606 | 5087 | 5102 | 126112 | 126127 | TCCACCTGAGCACTCA | 31 | 601 |

TABLE 9-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958611 | 5284 | 5299 | 126309 | 126324 | GAGCATGCTCTTACAT | 92 | 602 |
| 958616 | 1141 | 1156 | 79082 | 79097 | GGTGGTCTTGTTCTTA | 10 | 603 |
| 958621 | 1172 | 1187 | 79113 | 79128 | AACGAGGGTCAAGCCT | 29 | 604 |
| 958626 | N/A | N/A | 5475 | 5490 | TGGGCAAAGTTCCTAT | 158 | 605 |
| 958631 | N/A | N/A | 5583 | 5598 | TGCAAATAGGAGAGGG | 122 | 606 |
| 958636 | N/A | N/A | 3328 | 3343 | CCGCACCGCGGCCCGG | 126 | 607 |
| 958641 | N/A | N/A | 7512 | 7527 | AGCTACAGAGCTTAAC | 102 | 608 |
| 958646 | N/A | N/A | 10769 | 10784 | TATTATATGGCTAAGC | 26 | 609 |
| 958651 | N/A | N/A | 12678 | 12693 | AACTAAAGAGGACTTA | 62 | 610 |
| 958656 | N/A | N/A | 17870 | 17885 | ACGCAATCTGTGATCC | 48 | 611 |
| 958661 | N/A | N/A | 21191 | 21206 | TGCCGTTGGCCCCTCC | 120 | 612 |
| 958666 | N/A | N/A | 24643 | 24658 | GAAAGGGCAATCATA | 52 | 613 |
| 958671 | N/A | N/A | 30409 | 30424 | CATTATATGGCACCCA | 19 | 614 |
| 958676 | N/A | N/A | 31186 | 31201 | GAACTTAGTTCCCTAT | 34 | 615 |
| 958681 | N/A | N/A | 34104 | 34119 | AATTAACACCTGAGCT | 84 | 616 |
| 958686 | N/A | N/A | 36190 | 36205 | CGCAATATAGTCTATA | 4 | 617 |
| 958691 | N/A | N/A | 38179 | 38194 | TCAGTTGGCAACAGTC | 20 | 618 |
| 958696 | N/A | N/A | 40280 | 40295 | GCATACTACACTATAA | 56 | 619 |
| 958701 | N/A | N/A | 41534 | 41549 | TTAAACTAGGCACATT | 98 | 620 |
| 958706 | N/A | N/A | 45392 | 45407 | TCGCATGGCCACTGCC | 112 | 621 |
| 958711 | N/A | N/A | 48862 | 48877 | CCAAATAAGGATCTGT | 34 | 622 |
| 958716 | N/A | N/A | 54493 | 54508 | ATGGACTGTATGCAGC | 84 | 623 |
| 958721 | N/A | N/A | 56973 105504 | 56988 105519 | GTAGTATAATGAGTTA | 1 | 624 |
| 958726 | N/A | N/A | 58765 58781 | 58780 58796 | CTGTCAGTTATCCTAT | 3 | 625 |
| 958731 | N/A | N/A | 58768 58784 59523 | 58783 58799 59538 | GCTCTGTCAGTTATCC | 7 | 626 |
| 958736 | N/A | N/A | 62193 | 62208 | GTGATATGGATTCTGT | 3 | 627 |
| 958741 | N/A | N/A | 66072 | 66087 | GTTACTGCAACTGCCC | 14 | 628 |
| 958746 | N/A | N/A | 70253 | 70268 | GTTATCCTCTATAGTC | 22 | 629 |
| 958751 | N/A | N/A | 75535 | 75550 | TCAATGCAGGATTCCA | 30 | 630 |
| 958756 | N/A | N/A | 79463 | 79478 | GTGTTGCATGACAGCC | 15 | 631 |
| 958761 | N/A | N/A | 82824 | 82839 | AGTCTCAACAACCTTC | 7 | 632 |
| 958766 | N/A | N/A | 86559 | 86574 | TAACATATGTCTACTC | 23 | 633 |
| 958771 | N/A | N/A | 92071 | 92086 | CTACAGACGAATTCCA | 18 | 634 |
| 958776 | N/A | N/A | 94770 | 94785 | GGTACTCTCCTTCAGA | 94 | 635 |

TABLE 9-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958781 | N/A | N/A | 97391 | 97406 | GTCATCTATGTGTCCT | 6 | 636 |
| 958786 | N/A | N/A | 99922 | 99937 | TATGTCCTACTTTCCC | 10 | 637 |
| 958791 | N/A | N/A | 102044 | 102059 | CATAAGAAAAGACGAC | 123 | 638 |
| 958796 | N/A | N/A | 103309 | 103324 | ATTATATGGTTGCTTC | 3 | 639 |
| 958801 | N/A | N/A | 108999 | 109014 | CGCTAGCACGCGCGCT | 131 | 640 |
| 958806 | N/A | N/A | 112159 | 112174 | TGCCTAGGGTTCTGTG | 30 | 641 |
| 958811 | N/A | N/A | 115185 | 115200 | CACTGAGGCACGGCCC | 92 | 642 |
| 958816 | N/A | N/A | 120622 | 120637 | GTGATAACATATCCCA | 71 | 643 |

TABLE 10

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 2 | 206 |
| 958437 | 134 | 149 | 3594 | 3609 | AGGCACTCGGACCTGC | 84 | 644 |
| 958442 | 290 | 305 | 3750 | 3765 | GGAGAAGCGGCGACGG | 21 | 645 |
| 958447 | 404 | 419 | 3864 | 3879 | GTTGAGGCGGCGGCTG | 48 | 646 |
| 958452 | 571 | 586 | 4031 | 4046 | CTCCAGGTCGGTCTCC | 26 | 647 |
| 958457 | 857 | 872 | 7291 | 7306 | GTCGAAGATGCTGAGC | 5 | 648 |
| 958462 | 1439 | 1454 | 116628 | 116643 | ACTGGCTACGCAGGGC | 46 | 649 |
| 958467 | 1864 | 1879 | 122889 | 122904 | GGTGGCAGCCAAAACA | 32 | 650 |
| 958472 | 1945 | 1960 | 122970 | 122985 | TCCTTAGATCCTTCAC | 5 | 651 |
| 958477 | 1963 | 1978 | 122988 | 123003 | ATTTCCGGTGCATGTG | 2 | 652 |
| 958482 | 2000 | 2015 | 123025 | 123040 | TCTGTATTAGCCTGAA | 10 | 653 |
| 958487 | 2192 | 2207 | 123217 | 123232 | TCCAAACAGGCTCACT | 10 | 654 |
| 958492 | 2356 | 2371 | 123381 | 123396 | TGTCAGACCAGTAAAT | 12 | 655 |
| 958497 | 2534 | 2549 | 123559 | 123574 | ATATGGAAATTGTCTC | 1 | 656 |
| 958502 | 2722 | 2737 | 123747 | 123762 | CTATTAACAGATTCAC | 13 | 657 |
| 958507 | 2814 | 2829 | 123839 | 123854 | GAGCAGATAATCGAGA | 6 | 658 |
| 958512 | 2875 | 2890 | 123900 | 123915 | CATTCCACTACCACAC | 14 | 659 |
| 958517 | 3030 | 3045 | 124055 | 124070 | TCTAGAACACTAAACT | 88 | 660 |
| 958522 | 3156 | 3171 | 124181 | 124196 | AATTAGTCCAAGGGAG | 32 | 661 |
| 958527 | 3356 | 3371 | 124381 | 124396 | GTAAGTAAGAACAATC | 4 | 662 |
| 958532 | 3374 | 3389 | 124399 | 124414 | GAAGTAGGAGCAAGTC | 2 | 663 |

TABLE 10-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958537 | 3394 | 3409 | 124419 | 124434 | CAGGGTCAATTTTCAG | 3 | 664 |
|  |  |  | 79237 | 79252 |  |  |  |
| 958542 | 3408 | 3423 | 124433 | 124448 | TATAGTATTCTATCCA | 4 | 665 |
|  |  |  | 96503 | 96518 |  |  |  |
|  |  |  | 102951 | 102966 |  |  |  |
| 958547 | 3540 | 3555 | 124565 | 124580 | CACATACTCTAGTTAC | 4 | 666 |
|  |  |  | 56579 | 56594 |  |  |  |
| 958552 | 3555 | 3570 | 124580 | 124595 | TATTACTCCTGTAGAC | 16 | 667 |
| 958557 | 3641 | 3656 | 124666 | 124681 | CACAACCAACTATTAC | 10 | 668 |
| 958562 | 3691 | 3706 | 124716 | 124731 | CATTGAAAGACCCTTA | 6 | 669 |
| 958567 | 3938 | 3953 | 124963 | 124978 | TCAACCTATGAACTAT | 3 | 670 |
| 958572 | 4159 | 4174 | 125184 | 125199 | ATTATAGGCACTCCTT | 5 | 671 |
| 958577 | 4176 | 4191 | 125201 | 125216 | TCTGTGGCTACTGGCA | 4 | 672 |
| 958582 | 4206 | 4221 | 125231 | 125246 | AATCTGCTGATATATA | 21 | 673 |
| 958587 | 4364 | 4379 | 125389 | 125404 | GGTGACTGAAACTCTA | 2 | 674 |
| 958592 | 4488 | 4503 | 125513 | 125528 | CGTAAGATCAAAGCAC | 12 | 675 |
| 958597 | 4626 | 4641 | 125651 | 125666 | CCCAATACAACCAAGA | 6 | 676 |
| 958602 | 4936 | 4951 | 125961 | 125976 | TGCCATGTTCCATATA | 16 | 677 |
| 958607 | 5109 | 5124 | 126134 | 126149 | CAACATGCTTGCGAGG | 11 | 678 |
| 958612 | 5295 | 5310 | 126320 | 126335 | ACCTAACATATGAGCA | 18 | 679 |
| 958617 | 1143 | 1158 | 79084 | 79099 | GAGGTGGTCTTGTTCT | 40 | 680 |
| 958622 | 1384 | 1399 | 102516 | 102531 | GATATTCCGCATTGCC | 3 | 681 |
| 958627 | N/A | N/A | 5476 | 5491 | TTGGGCAAAGTTCCTA | 61 | 682 |
| 958632 | N/A | N/A | 5610 | 5625 | CTCCGACAGGAGACTA | 55 | 683 |
| 958637 | N/A | N/A | 4394 | 4409 | CCGCAGAGAGAAACTC | 101 | 684 |
| 958642 | N/A | N/A | 8249 | 8264 | GACATCAATTTCAGTC | 91 | 685 |
| 958647 | N/A | N/A | 10939 | 10954 | TAGGAAGTTGTTGACC | 11 | 686 |
| 958652 | N/A | N/A | 14156 | 14171 | GCTACGACGGCTGGCC | 136 | 687 |
| 958657 | N/A | N/A | 18786 | 18801 | CAGTATAATATCCTAA | 37 | 688 |
| 958662 | N/A | N/A | 21800 | 21815 | GAACAGATAGGACTAC | 51 | 689 |
| 958667 | N/A | N/A | 25870 | 25885 | TGCCGGGCCCCTATGC | 80 | 690 |
| 958672 | N/A | N/A | 30864 | 30879 | GAACTTAGTTCCCTTC | 67 | 691 |
| 958677 | N/A | N/A | 31187 | 31202 | AGAACTTAGTTCCCTA | 51 | 692 |
| 958682 | N/A | N/A | 34164 | 34179 | CCATGAGGGACTCCCA | 123 | 693 |
| 958687 | N/A | N/A | 36660 | 36675 | ACACTATGTGTTCTGC | 57 | 694 |
| 958692 | N/A | N/A | 39314 | 39329 | GGCTAGAGGCCGGGTG | 105 | 695 |
| 958697 | N/A | N/A | 40306 | 40321 | CTAAAGATGACTACTG | 39 | 696 |
| 958702 | N/A | N/A | 41672 | 41687 | TGATGTCTTGTCCAGA | 16 | 697 |

TABLE 10-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958707 | N/A | N/A | 46503 | 46518 | TCAATGCTGTATCAGA | 23 | 698 |
| 958712 | N/A | N/A | 49103 | 49118 | TTATATAGGTTACAGA | 52 | 699 |
| 958717 | N/A | N/A | 55730 | 55745 | AATAATATAGCTTACG | 11 | 700 |
| 958722 | N/A | N/A | 57612 | 57627 | CATAATAGGACACAAC | 59 | 701 |
| 958727 | N/A | N/A | 58767 | 58782 | ATCTGTCAGTTATCCT | 2 | 702 |
| 958732 | N/A | N/A | 59675 | 59690 | AGCACGGTGTAGCTTT | 60 | 703 |
| 958737 | N/A | N/A | 62586 | 62601 | GGAATACAAGCCCGAG | 8 | 704 |
| 958742 | N/A | N/A | 66232 | 66247 | AGCAATATGGTATTAG | 4 | 705 |
| 958747 | N/A | N/A | 72144 | 72159 | GTAAAGAGGGTGACAT | 106 | 706 |
| 958752 | N/A | N/A | 75582 | 75597 | GAATTTTAGTCCAGT | 2 | 707 |
| 958757 | N/A | N/A | 79978 | 79993 | GTGATCTGCACATTGT | 5 | 708 |
| 958762 | N/A | N/A | 84225 | 84240 | GATTAGAGGACTCATT | 16 | 709 |
| 958767 | N/A | N/A | 86751 | 86766 | ACGAATAAGGCATTAG | 6 | 710 |
| 958772 | N/A | N/A | 92334 | 92349 | CAACAAACATAGTTAC | 61 | 711 |
| 958777 | N/A | N/A | 94786 | 94801 | GTAACTGTTTCTAGGT | 10 | 712 |
| 958782 | N/A | N/A | 97670 | 97685 | ATGGTCTCCCAGTCAC | 20 | 713 |
| 958787 | N/A | N/A | 101109 | 101124 | TGGGCAAAGTTCCTCT | 67 | 714 |
| 958792 | N/A | N/A | 102355 | 102370 | GCCAATGGAGTCACCA | 46 | 715 |
| 958797 | N/A | N/A | 105351 | 105366 | ACGAGCACAGCACCCT | 13 | 716 |
| 958802 | N/A | N/A | 110683 | 110698 | AGATAATCATCCTCAA | 25 | 717 |
| 958807 | N/A | N/A | 112517 | 112532 | TCATTGTAGTCTGTCT | 3 | 718 |
| 958812 | N/A | N/A | 115821 | 115836 | TACTATAAGACACCAA | 31 | 719 |
| 958817 | N/A | N/A | 121734 | 121749 | TGCCAGGTAAGCCACA | 30 | 720 |

TABLE 11

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 1 | 206 |
| 958438 | 181 | 196 | 3641 | 3656 | CGCCCCGGCTCCACTG | 61 | 721 |
| 958443 | 306 | 321 | 3766 | 3781 | CTCCACGGGCCGAGGT | 90 | 722 |
| 958448 | 437 | 452 | 3897 | 3912 | GCGAAGGCGGCTGCCC | 86 | 723 |
| 958453 | 635 | 650 | 4095 | 4110 | GCCTCATGGGCACGGT | 70 | 724 |
| 958458 | 1006 | 1021 | 55501 | 55516 | GTTCATCTGGGACAGC | 12 | 725 |
| 958463 | 1502 | 1517 | 116691 | 116706 | CCTGAGACATCCCGGG | 63 | 726 |

TABLE 11-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958468 | 1866 | 1881 | 122891 | 122906 | TTGGTGGCAGCCAAAA | 86 | 727 |
| 958473 | 1948 | 1963 | 122973 | 122988 | GTCTCCTTAGATCCTT | 5 | 728 |
| 958478 | 1967 | 1982 | 122992 | 123007 | GGAAATTTCCGGTGCA | 14 | 729 |
| 958483 | 2039 | 2054 | 123064 | 123079 | GAGGATTAAAGTATCT | 17 | 730 |
| 958488 | 2209 | 2224 | 123234 | 123249 | AGGAATGGCATCCATC | 41 | 731 |
| 958493 | 2435 | 2450 | 123460 | 123475 | AAACAGTCTTCAGCCT | 16 | 732 |
| 958498 | 2561 | 2576 | 74512 | 74527 | GAGTATGTGGCAATAA | 1 | 733 |
|  |  |  | 123586 | 123601 |  |  |  |
| 958503 | 2740 | 2755 | 123765 | 123780 | AACCATCCCAAGCTAC | 15 | 734 |
| 958508 | 2816 | 2831 | 123841 | 123856 | GAGAGCAGATAATCGA | 7 | 735 |
| 958513 | 2927 | 2942 | 123952 | 123967 | GCGCTACCATTTTAAA | 104 | 736 |
| 958518 | 3047 | 3062 | 124072 | 124087 | CCACAGTAATAGCTCT | 1 | 737 |
| 958523 | 3174 | 3189 | 124199 | 124214 | TTCCAATCGAGACTTA | 3 | 738 |
| 958528 | 3362 | 3377 | 124387 | 124402 | AGTCTTGTAAGTAAGA | 18 | 739 |
| 958533 | 3379 | 3394 | 124404 | 124419 | GCATAGAAGTAGGAGC | 3 | 740 |
| 958538 | 3397 | 3412 | 31598 | 31613 | ATCCAGGGTCAATTTT | 10 | 741 |
|  |  |  | 124422 | 124437 |  |  |  |
| 958543 | 3412 | 3427 | 124437 | 124452 | ACCTTATAGTATTCTA | 4 | 742 |
| 958548 | 3542 | 3557 | 124567 | 124582 | GACACATACTCTAGTT | 21 | 743 |
| 958553 | 3559 | 3574 | 38752 | 38767 | CCATTATTACTCCTGT | 1 | 744 |
|  |  |  | 121706 | 121721 |  |  |  |
|  |  |  | 124584 | 124599 |  |  |  |
| 958558 | 3643 | 3658 | 124668 | 124683 | TTCACAACCAACTATT | 9 | 745 |
| 958563 | 3759 | 3774 | 124784 | 124799 | AGCTTTTGCCAGGAGA | 3 | 746 |
| 958568 | 3947 | 3962 | 124972 | 124987 | TATGAGTGATCAACCT | 5 | 747 |
| 958573 | 4164 | 4179 | 125189 | 125204 | GGCAAATTATAGGCAC | 2 | 748 |
| 958578 | 4181 | 4196 | 125206 | 125221 | CTTAATCTGTGGCTAC | 4 | 749 |
| 958583 | 4210 | 4225 | 125235 | 125250 | AGCTAATCTGCTGATA | 89 | 750 |
| 958588 | 4373 | 4388 | 125398 | 125413 | GTGTACTTAGGTGACT | 10 | 751 |
| 958593 | 4506 | 4521 | 125531 | 125546 | GGTCAGTACAGAGGGC | 7 | 752 |
| 958598 | 4636 | 4651 | 125661 | 125676 | CCCAATGCTACCCAAT | 4 | 753 |
| 958603 | 4987 | 5002 | 44310 | 44325 | TGGTATGAATTCTGAA | 3 | 754 |
|  |  |  | 75463 | 75478 |  |  |  |
|  |  |  | 126012 | 126027 |  |  |  |
| 958608 | 5136 | 5151 | 126161 | 126176 | TGATAGGCACACCCAC | 11 | 755 |
| 958613 | 1062 | 1077 | 55557 | 55572 | CCTGAAGCCGAGTTCA | 15 | 756 |
| 958618 | 1149 | 1164 | 79090 | 79105 | AGCCAAGAGGTGGTCT | 36 | 757 |
| 958623 | 1386 | 1401 | 102518 | 102533 | TTGATATTCCGCATTG | 3 | 758 |
| 958628 | N/A | N/A | 5514 | 5529 | GCTAACTACATTGCAG | 81 | 759 |

TABLE 11-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958633 | N/A | N/A | 5656 | 5671 | TGTCATCAGGTTAAGT | 76 | 760 |
| 958638 | N/A | N/A | 4565 | 4580 | GTGCGGAGCGCGCGGA | 127 | 761 |
| 958643 | N/A | N/A | 8457 | 8472 | TAGCAACCCACCCTGG | 59 | 762 |
| 958648 | N/A | N/A | 10980 | 10995 | GAATACTGAGTCAGGA | 7 | 763 |
| 958653 | N/A | N/A | 15503 | 15518 | TTACACACAGGCTATG | 17 | 764 |
| 958658 | N/A | N/A | 18787 | 18802 | ACAGTATAATATCCTA | 6 | 765 |
| 958663 | N/A | N/A | 22200 | 22215 | CTATTAGGGACTGAAC | 32 | 766 |
| 958668 | N/A | N/A | 27649 | 27664 | GTGATCTGTGAGAGGT | 2 | 767 |
| 958673 | N/A | N/A | 30865 | 30880 | AGAACTTAGTTCCCTT | 30 | 768 |
| 958678 | N/A | N/A | 32244 | 32259 | GGAGGAGTCACCATGG | 74 | 769 |
| 958683 | N/A | N/A | 34256 | 34271 | TATTGTGCTGCATCTC | 16 | 770 |
| 958688 | N/A | N/A | 36686 | 36701 | GGCTATGTAGCCTTCC | 82 | 771 |
| 958693 | N/A | N/A | 39371 | 39386 | GTGGTGTCTCACAGGC | 99 | 772 |
| 958698 | N/A | N/A | 40400 | 40415 | CTTATTAGCCCTCAAA | 30 | 773 |
| 958703 | N/A | N/A | 43429 | 43444 | GATAACTAAGCACTAC | 49 | 774 |
| 958708 | N/A | N/A | 46790 | 46805 | ATGTCAGATGTCAATT | 19 | 775 |
| 958713 | N/A | N/A | 50391 | 50406 | TGCTAGAGGCTGTTCC | 55 | 776 |
| 958718 | N/A | N/A | 55941 | 55956 | GAACACTATAGCTTGG | 4 | 777 |
| 958723 | N/A | N/A | 58021 | 58036 | AACCCACTAAAACCGG | 63 | 778 |
| 958728 | N/A | N/A | 45026 58768 58784 | 45041 58783 58799 | TATCTGTCAGTTATCC | 10 | 779 |
| 958733 | N/A | N/A | 60397 | 60412 | TAATAGACTAGACTTA | 67 | 780 |
| 958738 | N/A | N/A | 63528 | 63543 | TCTATATGTTTCCCCC | 11 | 781 |
| 958743 | N/A | N/A | 66740 | 66755 | GACTATAAAGGGTTTA | 30 | 782 |
| 958748 | N/A | N/A | 72564 | 72579 | ACATGTGACATTCCGG | 83 | 783 |
| 958753 | N/A | N/A | 76248 | 76263 | TGTATATGCCGTTCCC | 4 | 784 |
| 958758 | N/A | N/A | 79985 | 80000 | CTATTCAGTGATCTGC | 2 | 785 |
| 958763 | N/A | N/A | 84603 | 84618 | CACAATACAAGATGCA | 3 | 786 |
| 958768 | N/A | N/A | 87653 | 87668 | GTGCAAGCAGGTTCCC | 17 | 787 |
| 958773 | N/A | N/A | 93005 | 93020 | AGCTGGTAGGGCAAGA | 43 | 788 |
| 958778 | N/A | N/A | 95129 | 95144 | GCTACCTGGAGCGAAG | 75 | 789 |
| 958783 | N/A | N/A | 98257 | 98272 | TGATCTGATGCTTGCT | 35 | 790 |
| 958788 | N/A | N/A | 101110 | 101125 | CTGGGCAAAGTTCCTC | 54 | 791 |
| 958793 | N/A | N/A | 102510 | 102525 | CCGCATTGCCTAAGAG | 9 | 792 |
| 958798 | N/A | N/A | 107371 | 107386 | TGCAGTATAATATCCT | 3 | 793 |
| 958803 | N/A | N/A | 110998 | 111013 | GATAATCATCCTCAGC | 24 | 794 |
| 958808 | N/A | N/A | 113126 | 113141 | AGCGATTGGCCTCCCA | 59 | 795 |

TABLE 11-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958813 | N/A | N/A | 116872 | 116887 | TTACAGAGAGATTCAT | 8 | 796 |
| 958818 | N/A | N/A | 121757 | 121772 | GTTGTCAACTCTAGGG | 23 | 797 |

TABLE 12

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 1 | 206 |
| 958439 | 182 | 197 | 3642 | 3657 | GCGCCCCGGCTCCACT | 77 | 798 |
| 958444 | 315 | 330 | 3775 | 3790 | ACGCCCCGGCTCCACG | 97 | 799 |
| 958449 | 468 | 483 | 3928 | 3943 | CCGGACGGCGGGCCCT | 84 | 800 |
| 958454 | 754 | 769 | 7188 | 7203 | GGAATGAGCTCGAACA | 3 | 801 |
| 958459 | 1061 | 1076 | 55556 | 55571 | CTGAAGCCGAGTTCAT | 28 | 802 |
| 958464 | 1600 | 1615 | 120505 | 120520 | GCTCATGCTTAGTCCA | 3* | 803 |
| 958469 | 1904 | 1919 | 122929 | 122944 | GGCTCTATAACCATGT | 17 | 804 |
| 958474 | 1950 | 1965 | 122975 | 122990 | GTGTCTCCTTAGATCC | 3 | 805 |
| 958479 | 1969 | 1984 | 122994 | 123009 | ATGGAAATTTCCGGTG | 15 | 806 |
| 958484 | 2067 | 2082 | 123092 | 123107 | GCAGCAATGGACAAGG | 2 | 807 |
| 958489 | 2262 | 2277 | 123287 | 123302 | TTCTAAGTCTGAGTAT | 14 | 808 |
| 958494 | 2468 | 2483 | 123493 | 123508 | TAGCACTAGGAGGAAA | 28 | 809 |
| 958499 | 2565 | 2580 | 123590 | 123605 | ATTAGAGTATGTGGCA | 1 | 810 |
| 958504 | 2805 | 2820 | 123830 | 123845 | ATCGAGATTTAAATAA | 63 | 811 |
| 958509 | 2851 | 2866 | 123876 | 123891 | ATGTTATGTTTGGGTG | 4 | 812 |
| 958514 | 2957 | 2972 | 123982 | 123997 | TACTAGTCATGTATTC | 20 | 813 |
| 958519 | 3061 | 3076 | 124086 | 124101 | CCCCTAGGCACTATCC | 20 | 814 |
| 958524 | 3199 | 3214 | 124224 | 124239 | GCACATTATGAACCTA | 13 | 815 |
| 958529 | 3364 | 3379 | 124389 | 124404 | CAAGTCTTGTAAGTAA | 3 | 816 |
| 958534 | 3383 | 3398 | 121836 124408 | 121851 124423 | TTCAGCATAGAAGTAG | 3 | 817 |
| 958539 | 3400 | 3415 | 124425 | 124440 | TCTATCCAGGGTCAAT | 11 | 818 |
| 958544 | 3471 | 3486 | 124496 | 124511 | GCTAAATTCAACTACC | 8 | 819 |
| 958549 | 3546 | 3561 | 100828 110388 124571 | 100843 110403 124586 | TGTAGACACATACTCT | 8 | 820 |
| 958554 | 3561 | 3576 | 38754 120229 124586 | 38769 120244 124601 | AACCATTATTACTCCT | 1 | 821 |
| 958559 | 3645 | 3660 | 124670 | 124685 | AATTCACAACCAACTA | 17 | 822 |

TABLE 12-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958564 | 3841 | 3856 | 124866 | 124881 | TCCAAATTGAAGGGCC | 62 | 823 |
| 958569 | 3965 | 3980 | 124990 | 125005 | AGCCTTAGAGTCAATT | 3 | 824 |
| 958574 | 4166 | 4181 | 125191 | 125206 | CTGGCAAATTATAGGC | 13 | 825 |
| 958579 | 4183 | 4198 | 125208 | 125223 | ATCTTAATCTGTGGCT | 4 | 826 |
| 958584 | 4221 | 4236 | 125246 | 125261 | CCCTAAGCTAAAGCTA | 74 | 827 |
| 958589 | 4409 | 4424 | 125434 | 125449 | GTAAAGGAAGATCTCC | 4 | 828 |
| 958594 | 4523 | 4538 | 125548 | 125563 | CTCTTAGGTCTCCTTC | 8 | 829 |
| 958599 | 4663 | 4678 | 125688 | 125703 | TTCAAGAATACCCAGT | 5 | 830 |
| 958604 | 5055 | 5070 | 126080 | 126095 | ACGCTAGAAAAGTGTT | 94 | 831 |
| 958609 | 5221 | 5236 | 126246 | 126261 | TGACAAGTGTGCATTA | 16 | 832 |
| 958614 | 1137 | 1152 | 79078 | 79093 | GTCTTGTTCTTATGGT | 6 | 833 |
| 958619 | 1156 | 1171 | 79097 | 79112 | TGGGTCTAGCCAAGAG | 71 | 834 |
| 958624 | 1390 | 1405 | 102522 | 102537 | GGGATTGATATTCCGC | 74 | 835 |
| 958629 | N/A | N/A | 5523 | 5538 | CCCGAGTGGGCTAACT | 128 | 836 |
| 958634 | N/A | N/A | 5673 | 5688 | TCCTTAACCCGGGTTT | 61 | 837 |
| 958639 | N/A | N/A | 6783 | 6798 | GTTATGGGTGCTTTTC | 18 | 838 |
| 958644 | N/A | N/A | 8524 | 8539 | ATGATCAAACCTTTTC | 5 | 839 |
| 958649 | N/A | N/A | 12237 | 12252 | TGCCACTGGTGAATAC | 36 | 840 |
| 958654 | N/A | N/A | 16919 | 16934 | AATGGAGTGGCCGGGC | 110 | 841 |
| 958659 | N/A | N/A | 18852 | 18867 | GTTGTATTACTCTCCA | 2 | 842 |
| 958664 | N/A | N/A | 23239 | 23254 | ACGAACTAAGGTGTAC | 40 | 843 |
| 958669 | N/A | N/A | 28420 | 28435 | GCTATCTTTGGATCCA | 76 | 844 |
| 958674 | N/A | N/A | 30866 31188 | 30881 31203 | AAGAACTTAGTTCCCT | 25 | 845 |
| 958679 | N/A | N/A | 33917 | 33932 | GTAACTGCCACAGTTA | 77 | 846 |
| 958684 | N/A | N/A | 35513 | 35528 | GCTGAAGACGGCCCTT | 70 | 847 |
| 958689 | N/A | N/A | 36864 | 36879 | CATTAAGGAGGTTATG | 87 | 848 |
| 958694 | N/A | N/A | 39375 | 39390 | ATTGGTGGTGTCTCAC | 41 | 849 |
| 958699 | N/A | N/A | 40415 | 40430 | GACTAGAAAGATCATC | 20 | 850 |
| 958704 | N/A | N/A | 43572 | 43587 | CCCTACACTCGAGGAT | 122 | 851 |
| 958709 | N/A | N/A | 46944 | 46959 | TCAATCTATGAGACCC | 57 | 852 |
| 958714 | N/A | N/A | 52275 | 52290 | GAGCACTGCGCCCTGG | 82 | 853 |
| 958719 | N/A | N/A | 56409 | 56424 | GTACATAATGGGCTAA | 49 | 854 |
| 958724 | N/A | N/A | 58762 | 58777 | TCAGTTATCCTATCCC | 2 | 855 |
| 958729 | N/A | N/A | 58763 58779 | 58778 58794 | GTCAGTTATCCTATCT | 4 | 856 |
| 958734 | N/A | N/A | 61207 | 61222 | ACACATAGAGCTAAGG | 7 | 857 |

TABLE 12-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958739 | N/A | N/A | 64256 | 64271 | AGCAATAGAGTAACCA | 4 | 858 |
| 958744 | N/A | N/A | 67858 | 67873 | GCATACTGGTGCCCCA | 45 | 859 |
| 958749 | N/A | N/A | 74623 | 74638 | CCACAAGGGCAGTACG | 51 | 860 |
| 958754 | N/A | N/A | 77489 | 77504 | CCTTAGGAAGGCTCCC | 31 | 861 |
| 958759 | N/A | N/A | 81664 | 81679 | GCCTATCGCCCCAAGC | 61 | 862 |
| 958764 | N/A | N/A | 85543 | 85558 | TGGGTCTCTTGATTTC | 34 | 863 |
| 958769 | N/A | N/A | 89667 | 89682 | CATTGCCACGATCTAA | 36 | 864 |
| 958774 | N/A | N/A | 94013 | 94028 | TGCTAGATATCGCCAA | 33 | 865 |
| 958779 | N/A | N/A | 95898 | 95913 | TCGAATATAGAGGCCT | 80 | 866 |
| 958784 | N/A | N/A | 99202 | 99217 | GGCTGGATAGAATGCT | 79 | 867 |
| 958789 | N/A | N/A | 101277 | 101292 | TACTATATAATACCCT | 17 | 868 |
| 958794 | N/A | N/A | 102512 | 102527 | TTCCGCATTGCCTAAG | 14 | 869 |
| 958799 | N/A | N/A | 107814 | 107829 | ATTACTCAATCATGGT | 2 | 870 |
| 958804 | N/A | N/A | 110999 | 111014 | AGATAATCATCCTCAG | 17 | 871 |
| 958809 | N/A | N/A | 113144 | 113159 | TCTTAACACCTGAGCT | 66 | 872 |
| 958814 | N/A | N/A | 117837 | 117852 | GGCTATGCCTCTCTTA | 214 | 873 |
| 958819 | N/A | N/A | 122502 | 122517 | TGCTTCAACATTGTTC | 9 | 874 |

TABLE 13

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 715483 | 3570 | 3585 | 124595 | 124610 | CTCTTTGGAAACCATT | 1 | 206 |
| 958440 | 183 | 198 | 3643 | 3658 | TGCGCCCCGGCTCCAC | 54 | 875 |
| 958445 | 327 | 342 | 3787 | 3802 | GGCTACGCCCGGACGC | 63 | 876 |
| 958450 | 496 | 511 | 3956 | 3971 | GGTCGCCGCGGGTGCC | 59 | 877 |
| 958455 | 757 | 772 | 7191 | 7206 | AGAGGAATGAGCTCGA | 43 | 878 |
| 958460 | 1294 | 1309 | 98996 | 99011 | TCGCATCTGTTGCTGC | 52 | 879 |
| 958465 | 1726 | 1741 | 122751 | 122766 | GGCTTCAAGGTAGTCT | 84 | 880 |
| 958470 | 1941 | 1956 | 8781<br>45134<br>122966 | 8796<br>45149<br>122981 | TAGATCCTTCACAGAT | 18 | 881 |
| 958475 | 1959 | 1974 | 122984 | 122999 | CCGGTGCATGTGTCTC | 37 | 882 |
| 958480 | 1978 | 1993 | 24075<br>123003 | 24090<br>123018 | AACTGGCTTATGGAAA | 24 | 883 |
| 958485 | 2089 | 2104 | 56507<br>122015<br>123114 | 56522<br>122030<br>123129 | AGAGGTCAGCAATACA | 3 | 884 |

TABLE 13-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958490 | 2281 | 2296 | 123306 | 123321 | GTGACATGAAGCATCT | 5 | 885 |
| 958495 | 2488 | 2503 | 123513 | 123528 | GGTCATTATGTGACTA | 56 | 886 |
| 958500 | 2570 | 2585 | 123595 | 123610 | TCTATATTAGAGTATG | 5 | 887 |
| 958505 | 2809 | 2824 | 123834 | 123849 | GATAATCGAGATTTAA | 6 | 888 |
| 958510 | 2867 | 2882 | 123892 | 123907 | TACCACACTATTATAA | 43 | 889 |
| 958515 | 2993 | 3008 | 124018 | 124033 | CCCCAACCAGATTTAA | 28 | 890 |
| 958520 | 3091 | 3106 | 124116 | 124131 | CTACCGTATGCCCAGA | 27 | 891 |
| 958525 | 3235 | 3250 | 124260 | 124275 | ATGAAGGTAAACCACT | 3 | 892 |
| 958530 | 3367 | 3382 | 124392 | 124407 | GAGCAAGTCTTGTAAG | 20 | 893 |
| 958535 | 3392 | 3407 | 124417 | 124432 | GGGTCAATTTTCAGCA | 10 | 894 |
| 958540 | 3402 | 3417 | 124427 | 124442 | ATTCTATCCAGGGTCA | 8 | 895 |
| 958545 | 3535 | 3550 | 5536 124560 | 5551 124575 | ACTCTAGTTACATCAT | 3 | 896 |
| 958550 | 3548 | 3563 | 124573 | 124588 | CCTGTAGACACATACT | 4 | 897 |
| 958555 | 3619 | 3634 | 124644 | 124659 | GCTTATATTGAAGAGT | 4 | 898 |
| 958560 | 3656 | 3671 | 124681 | 124696 | GGTGCCACTTTAATTC | 22 | 899 |
| 958565 | 3895 | 3910 | 124920 | 124935 | TTGAGCACTGAAAGTA | 4 | 900 |
| 958570 | 4092 | 4107 | 125117 | 125132 | TGTAATTCATATACCC | 5 | 901 |
| 958575 | 4171 | 4186 | 125196 | 125211 | GGCTACTGGCAAATTA | 9 | 902 |
| 958580 | 4186 | 4201 | 125211 | 125226 | ATAATCTTAATCTGTG | 4 | 903 |
| 958585 | 4278 | 4293 | 125303 | 125318 | CTCTATCAAGGTCCCC | 5 | 904 |
| 958590 | 4439 | 4454 | 125464 | 125479 | AGGTATAACTGGGCAA | 2 | 905 |
| 958595 | 4563 | 4578 | 125588 | 125603 | CCACATCAAGGCTATG | 8 | 906 |
| 958600 | 4752 | 4767 | 125777 | 125792 | GTAGATCTAAGAAGCC | 8 | 907 |
| 958605 | 5068 | 5083 | 126093 | 126108 | CTCAGATGTACCAACG | 7 | 908 |
| 958610 | 5250 | 5265 | 126275 | 126290 | AGGTAACATTGGTACT | 34 | 909 |
| 958615 | 1139 | 1154 | 79080 | 79095 | TGGTCTTGTTCTTATG | 3 | 910 |
| 958620 | 1162 | 1177 | 79103 | 79118 | AAGCCTTGGGTCTAGC | 57 | 911 |
| 958625 | 1394 | 1409 | 102526 | 102541 | TGCTGGGATTGATATT | 6 | 912 |
| 958630 | N/A | N/A | 5554 | 5569 | GCGGTAACTCTTCTTT | 52 | 913 |
| 958635 | N/A | N/A | 5713 | 5728 | GTTTAGGCAAGCAGCT | 43 | 914 |
| 958640 | N/A | N/A | 7413 | 7428 | TAGATAACTGTCTCCC | 13 | 915 |
| 958645 | N/A | N/A | 9559 | 9574 | GCCCATAGTTGACAGG | 54 | 916 |
| 958650 | N/A | N/A | 12498 | 12513 | TCAATTGAGTCTGCTA | 3 | 917 |
| 958655 | N/A | N/A | 17868 | 17883 | GCAATCTGTGATCCCA | 12 | 918 |
| 958660 | N/A | N/A | 19378 | 19393 | CCCACTGGGTTTGTCC | 106 | 919 |
| 958665 | N/A | N/A | 23878 | 23893 | CTGCATACCCTCCAGC | 84 | 920 |

TABLE 13-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958670 | N/A | N/A | 28665 | 28680 | GGTCTTGGTGATTGGC | 20 | 921 |
| 958675 | N/A | N/A | 31177 | 31192 | TCCCTATCAGCTGGGC | 112 | 922 |
| 958680 | N/A | N/A | 34103 | 34118 | ATTAACACCTGAGCTG | 50 | 923 |
| 958685 | N/A | N/A | 35577 | 35592 | AGCTATGGAAAGTGTC | 24 | 924 |
| 958690 | N/A | N/A | 37103 | 37118 | TGGACTCTTGATCACA | 26 | 925 |
| 958695 | N/A | N/A | 39759 | 39774 | TCAATTCTCCACCAGA | 45 | 926 |
| 958700 | N/A | N/A | 41085 | 41100 | CTAATATAGACTACTC | 55 | 927 |
| 958705 | N/A | N/A | 45162 | 45177 | GGCCATCAATAAAGAC | 112 | 928 |
| 958710 | N/A | N/A | 47735 | 47750 | AGGGAACCCTTGGCTA | 77 | 929 |
| 958715 | N/A | N/A | 53767 | 53782 | GTAATAGGAGGTAAGA | 48 | 930 |
| 958720 | N/A | N/A | 56594 | 56609 | GTCTACTAGAGCTGCC | 12 | 931 |
| 958725 | N/A | N/A | 58763 | 58778 | GTCAGTTATCCTATCC | 1 | 932 |
| 958730 | N/A | N/A | 58783 | 58798 | CTCTGTCAGTTATCCT | 4 | 933 |
| 958735 | N/A | N/A | 61265 | 61280 | AGCAATCTTGTGGATC | 7 | 934 |
| 958740 | N/A | N/A | 65047 | 65062 | CGGCACCAAACACCCA | 57 | 935 |
| 958745 | N/A | N/A | 69906 | 69921 | TCCCAGCCGCATGGCT | 78 | 936 |
| 958750 | N/A | N/A | 75333 | 75348 | TGTAAGAGGAGACCAC | 28 | 937 |
| 958755 | N/A | N/A | 78709 | 78724 | TAACATAAGACACGGA | 12 | 938 |
| 958760 | N/A | N/A | 82249 | 82264 | AGTAATAGATCTACAA | 76 | 939 |
| 958765 | N/A | N/A | 86532 | 86547 | GTACAGGAGAGATTGC | 37 | 940 |
| 958770 | N/A | N/A | 90915 | 90930 | ACAGAGCGGTGCACCC | 64 | 941 |
| 958775 | N/A | N/A | 94061 | 94076 | GTCTATACGGGAGATT | 29 | 942 |
| 958780 | N/A | N/A | 96542 | 96557 | TCAACTACTTTTCAGC | 24 | 943 |
| 958785 | N/A | N/A | 99371 | 99386 | GCAATCCACAATTCCA | 2 | 944 |
| 958790 | N/A | N/A | 102039 | 102054 | GAAAAGACGACACAGT | 68 | 945 |
| 958795 | N/A | N/A | 102514 | 102529 | TATTCCGCATTGCCTA | 8 | 946 |
| 958800 | N/A | N/A | 108359 | 108374 | TCGATAATATATGGCA | 22 | 947 |
| 958805 | N/A | N/A | 111001 | 111016 | CAAGATAATCATCCTC | 6 | 948 |
| 958810 | N/A | N/A | 114182 | 114197 | TTATATACGGGAAAAT | 47 | 949 |
| 958815 | N/A | N/A | 120003 | 120018 | GGGCGAGGAGACAGGT | 16 | 950 |
| 958820 | N/A | N/A | 126468 | 126483 | GACCAGTAAGAAGCCA | 49 | 951 |

Example 4

Antisense Inhibition of Human Yap1 in A-431 Cells by cEt Gapmers

Modified oligonucleotides were designed to target a Yap1 nucleic acid and were tested for their effect on Yap1 mRNA level in vitro. The modified oligonucleotides were tested in a series of experiments that had similar culture conditions. The results for each experiment are presented in separate tables shown below. Cultured A-431 cells at a density of 5,000 cells per well were treated using free uptake with 2,000 nM of modified oligonucleotide. After a treatment period of approximately 48 hours, RNA was isolated from the cells and Yap1 mRNA levels were measured by quantitative real-time RTPCR. Human primer probe set RTS4814 was used to measure mRNA levels. Yap1 mRNA levels were normalized to total RNA content, as measured by RIBOGREEN®. Results are presented in the tables below as percent control of the amount of Yap1 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1, SEQ ID NO.: 2, SEQ ID NO.: 3 (GENBANK Accession No. NM_006106.4), or SEQ ID NO.: 4 (GENBANK Accession No. NM_001130145.2). 'N/A' indicates that the modified oligonucleotide does not target that particular gene sequence with 100% complementarity. 'N.D.' indicates that the % UTC is not defined for that particular modified oligonucleotide in that particular experiment. Activity of the modified oligonucleotide may be defined in a different experiment.

TABLE 14

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074112 | 97 | 112 | 3557 | 3572 | TCCAACTCCCTTGACG | 83 | 952 |
| 1074144 | 285 | 300 | 3745 | 3760 | AGCGGCGACGGCTGCG | 92 | 953 |
| 1074176 | 364 | 379 | 3824 | 3839 | CTCCCCCGACGCGCAC | 84 | 954 |
| 1074208 | 541 | 556 | 4001 | 4016 | GTGCACGATCTGATGC | 96 | 955 |
| 1074240 | 896 | 911 | 7330 | 7345 | CTGGCAGAGGTACATC | 29 | 956 |
| 1074272 | 1118 | 1133 | 79059 | 79074 | TATAGTAAATTTCTCC | 16 | 957 |
| 1074304 | 1357 | 1372 | 99059 | 99074 | CTGCCGAAGCAGTTCT | 109 | 958 |
| 1074336 | 1451 | 1466 | 116640 | 116655 | CCAGTGTTGGTAACTG | 97 | 959 |
| 1074368 | 1672 | 1687 | N/A | N/A | GATAGTATCACCTGTA | 8 | 960 |
| 1074400 | 1928 | 1943 | 122953 | 122968 | GATTTAGAATTCAGTC | 42 | 961 |
| 1074432 | 2243 | 2258 | 123268 | 123283 | GTTAAAATGATTGGTG | 3* | 962 |
| 1074464 | 2564 | 2579 | 123589 | 123604 | TTAGAGTATGTGGCAA | 2 | 963 |
| 1074496 | 2743 | 2758 | 123768 | 123783 | AATAACCATCCCAAGC | 69 | 964 |
| 1074528 | 2996 | 3011 | 124021 | 124036 | CTGCCCCAACCAGATT | 25 | 965 |
| 1074560 | 3172 | 3187 | 124197 | 124212 | CCAATCGAGACTTAAA | 3 | 966 |
| 1074592 | 3368 | 3383 | 124393 | 124408 | GGAGCAAGTCTTGTAA | 23 | 967 |
| 1074624 | 3706 | 3721 | 124731 | 124746 | GGCTTATTCTAGAAAC | 65 | 968 |
| 1074656 | 4008 | 4023 | 125033 | 125048 | GACTTAATTCAAGATT | 31 | 969 |
| 1074688 | 4224 | 4239 | 125249 | 125264 | TCCCCCTAAGCTAAAG | 83 | 970 |
| 1074720 | 4403 | 4418 | 125428 | 125443 | GAAGATCTCCATATTC | 58 | 971 |
| 1074752 | 4592 | 4607 | 125617 | 125632 | CATTAGGAACAAGGAC | 10 | 972 |
| 1074784 | 4758 | 4773 | 125783 | 125798 | CCATAAGTAGATCTAA | 25 | 973 |
| 1074816 | 5032 | 5047 | 126057 | 126072 | GAATATTGCCACCCAC | 15 | 974 |
| 1074848 | 5140 | 5155 | 126165 | 126180 | GTTATGATAGGCACAC | 11 | 975 |
| 1074912 | N/A | N/A | 5525 | 5540 | ATCCCGAGTGGGCTAA | 85 | 976 |

TABLE 14-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074944 | N/A | N/A | 5623 | 5638 | AAAACCCTTTGGTCTC | 89 | 977 |
| 1074976 | N/A | N/A | 126479 | 126494 | TTCTATTGGAAGACCA | 35 | 978 |
| 1075008 | N/A | N/A | 5286 | 5301 | TAATCGAACATTGTGT | 61 | 979 |
| 1075040 | N/A | N/A | 7618 | 7633 | TTATAAAGAGGCTCAG | 10 | 980 |
| 1075072 | N/A | N/A | 9650 | 9665 | TCCGGGTAAATATCTC | 37 | 981 |
| 1075104 | N/A | N/A | 11109 | 11124 | ATTATAAGGTCCTACA | 67 | 982 |
| 1075136 | N/A | N/A | 13294 | 13309 | CTAGAATATTAAAGGG | 87 | 983 |
| 1075168 | N/A | N/A | 16596 | 16611 | CATCAAAATTTCACGA | 49 | 984 |
| 1075200 | N/A | N/A | 21836 | 21851 | CATATTAACTAGATGA | 120 | 985 |
| 1075232 | N/A | N/A | 24676 | 24691 | ATTTATCAGCCATTGT | 13 | 986 |
| 1075264 | N/A | N/A | 27401 | 27416 | GAATAATATGCAGAAC | 53 | 987 |
| 1075296 | N/A | N/A | 30827 | 30842 | ATTATAAGCTGTGTTG | 18 | 988 |
| 1075328 | N/A | N/A | 32291 | 32306 | CTCGCAAAGCCTCTTC | 21 | 989 |
| 1075360 | N/A | N/A | 34021 | 34036 | AGGCAACAACATCTAA | 50 | 990 |
| 1075392 | N/A | N/A | 36045 | 36060 | GACGGGTGAACCTGTT | 95 | 991 |
| 1075424 | N/A | N/A | 38749 | 38764 | TTATTAATCCTGTCCA | 18 | 992 |
| 1075456 | N/A | N/A | 40812 | 40827 | TTACGAAATGTTTAGT | 61 | 993 |
| 1075488 | N/A | N/A | 42808 | 42823 | CAGAATAAGGGAGATC | 56 | 994 |
| 1075520 | N/A | N/A | 45363 | 45378 | CCCCAACAACTGCTAA | 77 | 995 |
| 1075552 | N/A | N/A | 47526 | 47541 | GATTATAACATGCTGT | 74 | 996 |
| 1075584 | N/A | N/A | 49326 | 49341 | AATAATTGACCTAGCA | 57 | 997 |
| 1075616 | N/A | N/A | 51128 | 51143 | GTAAAACCGATTTTTC | 46 | 998 |
| 1075648 | N/A | N/A | 52713 | 52728 | TCAATAAAGTGGGACT | 67 | 999 |
| 1075680 | N/A | N/A | 55168 | 55183 | ATTATTACCCCTTCTA | 73 | 1000 |
| 1075712 | N/A | N/A | 57557 | 57572 | GACGCGAAATACTTAC | 7 | 1001 |
| 1075744 | N/A | N/A | 59642 | 59657 | TTCGGGTTAGCAGACT | 6 | 1002 |
| 1075776 | N/A | N/A | 62195 | 62210 | ATGTGATATGGATTCT | 10 | 1003 |
| 1075808 | N/A | N/A | 64255 | 64270 | GCAATAGAGTAACCAG | 3 | 1004 |
| 1075840 | N/A | N/A | 67174 | 67189 | CCTAAATAGGAATGC | 89 | 1005 |
| 1075872 | N/A | N/A | 70920 | 70935 | CAATTATGACAAACAG | 21 | 1006 |
| 1075904 | N/A | N/A | 73288 | 73303 | GTATAGGATCTACTAA | 51 | 1007 |
| 1075936 | N/A | N/A | 76577 | 76592 | CTTATATTCTCTCCGA | 49 | 1008 |
| 1075968 | N/A | N/A | 80319 | 80334 | TATTTAAGCCAAACCG | 5 | 1009 |
| 1076000 | N/A | N/A | 82082 | 82097 | CCTAATATGACTCCTT | 4 | 1010 |
| 1076032 | N/A | N/A | 84424 | 84439 | TATAATTTCCCTGATC | 105 | 1011 |
| 1076064 | N/A | N/A | 86676 | 86691 | TATGAACAATGTACTC | 5 | 1012 |

TABLE 14-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076096 | N/A | N/A | 90315 | 90330 | AATAATAAACGATTCT | 71 | 1013 |
| 1076128 | N/A | N/A | 92094 | 92109 | TCTAAACCTAAAGACT | 118 | 1014 |
| 1076160 | N/A | N/A | 93143 | 93158 | TTATACTAGTACGGCA | 20 | 1015 |
| 1076192 | N/A | N/A | 95979 | 95994 | CTACAACCTGGACTTT | 34 | 1016 |
| 1076224 | N/A | N/A | 97726 | 97741 | TATAAACCTTGCTACA | 67 | 1017 |
| 1076256 | N/A | N/A | 100250 | 100265 | TTATTTAGGCCCCATA | 4 | 1018 |
| 1076288 | N/A | N/A | 103352 | 103367 | CTTATTTAGCATAGTG | 3 | 1019 |
| 1076320 | N/A | N/A | 105383 | 105398 | CATTAACCTCACCCAT | 52 | 1020 |
| 1076352 | N/A | N/A | 109308 | 109323 | GATAACCCTGAAACAA | 37 | 1021 |
| 1076384 | N/A | N/A | 111269 | 111284 | TATAAGGGACTTGCTG | 25 | 1022 |
| 1076416 | N/A | N/A | 113834 | 113849 | ACCGAAATGATACTGA | 8 | 1023 |
| 1076448 | N/A | N/A | 117100 | 117115 | CTTATAATGCAATCCT | 2 | 1024 |
| 1076480 | N/A | N/A | 119636 | 119651 | GTAAATATCCATTACC | 72 | 1025 |
| 1076512 | N/A | N/A | 122045 | 122060 | CATAAACCATTAAGTG | 65 | 1026 |
| 1076544 | N/A | N/A | 71389 | 71404 | GACCAACCTCCCCTTG | 89 | 1027 |

TABLE 15

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074113 | 98 | 113 | 3558 | 3573 | CTCCAACTCCCTTGAC | 61 | 1028 |
| 1074145 | 286 | 301 | 3746 | 3761 | AAGCGGCGACGGCTGC | 73 | 1029 |
| 1074177 | 365 | 380 | 3825 | 3840 | CCTCCCCGACGCGCA | 69 | 1030 |
| 1074209 | 640 | 655 | 4100 | 4115 | CCGGAGCCTCATGGGC | 72 | 1031 |
| 1074241 | 921 | 936 | 7355 | 7370 | GATGTCTTTGCCATCT | 72 | 1032 |
| 1074273 | 1129 | 1144 | 79070 | 79085 | CTTATGGTTTATATAG | 34 | 1033 |
| 1074305 | 1360 | 1375 | 99062 | 99077 | CACCTGCCGAAGCAGT | 64 | 1034 |
| 1074337 | 1469 | 1484 | 116658 | 116673 | GAGTCCACCATCCTG | 10 | 1035 |
| 1074369 | 1673 | 1688 | N/A | N/A | TGATAGTATCACCTGT | 19 | 1036 |
| 1074401 | 1960 | 1975 | 122985 | 123000 | TCCGGTGCATGTGTCT | 18 | 1037 |
| 1074433 | 2258 | 2273 | 123283 | 123298 | AAGTCTGAGTATTTAG | 5* | 1038 |
| 1074465 | 2572 | 2587 | 123597 | 123612 | AATCTATATTAGAGTA | 44 | 1039 |
| 1074497 | 2744 | 2759 | 123769 | 123784 | CAATAACCATCCCAAG | 26 | 1040 |
| 1074529 | 3001 | 3016 | 124026 | 124041 | GCAGACTGCCCCAACC | 50 | 1041 |

TABLE 15-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074561 | 3176 | 3191 | 124201 | 124216 | AATTCCAATCGAGACT | 10 | 1042 |
| 1074593 | 3369 | 3384 | 124394 | 124409 | AGGAGCAAGTCTTGTA | 6 | 1043 |
| 1074625 | 3711 | 3726 | 124736 | 124751 | ATAAGGGCTTATTCTA | 42 | 1044 |
| 1074657 | 4016 | 4031 | 125041 | 125056 | TCCCCCCAGACTTAAT | 59 | 1045 |
| 1074689 | 4225 | 4240 | 125250 | 125265 | CTCCCCCTAAGCTAAA | 70 | 1046 |
| 1074721 | 4404 | 4419 | 125429 | 125444 | GGAAGATCTCCATATT | 43 | 1047 |
| 1074753 | 4594 | 4609 | 125619 | 125634 | TACATTAGGAACAAGG | 4 | 1048 |
| 1074785 | 4759 | 4774 | 125784 | 125799 | ACCATAAGTAGATCTA | 10 | 1049 |
| 1074817 | 5034 | 5049 | 126059 | 126074 | CTGAATATTGCCACCC | 8 | 1050 |
| 1074849 | 5141 | 5156 | 126166 | 126181 | TGTTATGATAGGCACA | 18 | 1051 |
| 1074913 | N/A | N/A | 5526 | 5541 | CATCCCGAGTGGGCTA | 99 | 1052 |
| 1074945 | N/A | N/A | 5624 | 5639 | CAAAACCCTTTGGTCT | 74 | 1053 |
| 1074977 | N/A | N/A | 126483 | 126498 | CTTGTTCTATTGGAAG | 94 | 1054 |
| 1075009 | N/A | N/A | 5287 | 5302 | ATAATCGAACATTGTG | 43 | 1055 |
| 1075041 | N/A | N/A | 7620 | 7635 | GATTATAAAGAGGCTC | 5 | 1056 |
| 1075073 | N/A | N/A | 9719 | 9734 | CATAAAAGTTCCCCAG | 51 | 1057 |
| 1075105 | N/A | N/A | 11110 | 11125 | AATTATAAGGTCCTAC | 42 | 1058 |
| 1075137 | N/A | N/A | 13320 | 13335 | GATTAAATACTGACCA | 3 | 1059 |
| 1075169 | N/A | N/A | 16611 | 16626 | AAAACGGAGTAATGCC | 39 | 1060 |
| 1075201 | N/A | N/A | 21864 | 21879 | CTTTAAAGCCCTAATT | 114 | 1061 |
| 1075233 | N/A | N/A | 24679 | 24694 | GTAATTTATCAGCCAT | 2 | 1062 |
| 1075265 | N/A | N/A | 27404 | 27419 | TCTGAATAATATGCAG | 44 | 1063 |
| 1075297 | N/A | N/A | 30831 | 30846 | GTTAATTATAAGCTGT | 10 | 1064 |
| 1075329 | N/A | N/A | 32457 | 32472 | AGGGAAAACTTTGCAC | 26 | 1065 |
| 1075361 | N/A | N/A | 34085 | 34100 | TCTTAAGGGAATGTAT | 69 | 1066 |
| 1075393 | N/A | N/A | 36169 | 36184 | CTTAACCTATGCCAAA | 37 | 1067 |
| 1075425 | N/A | N/A | 38750 | 38765 | ATTATTAATCCTGTCC | 26 | 1068 |
| 1075457 | N/A | N/A | 40828 | 40843 | AGTAATATGTACATGG | 5 | 1069 |
| 1075489 | N/A | N/A | 42854 | 42869 | GAGCAACAACTATGAG | 51 | 1070 |
| 1075521 | N/A | N/A | 45427 | 45442 | AAATCGAGGCGAATCT | 65 | 1071 |
| 1075553 | N/A | N/A | 47527 | 47542 | TGATTATAACATGCTG | 77 | 1072 |
| 1075585 | N/A | N/A | 49327 | 49342 | AAATAATTGACCTAGC | 52 | 1073 |
| 1075617 | N/A | N/A | 51372 | 51387 | TAAGAACGACATATGC | 27 | 1074 |
| 1075649 | N/A | N/A | 52715 | 52730 | CTTCAATAAAGTGGGA | 56 | 1075 |
| 1075681 | N/A | N/A | 55170 | 55185 | TAATTATTACCCCTTC | 37 | 1076 |
| 1075713 | N/A | N/A | 57571 | 57586 | AATCAACCTTGTTAGA | 58 | 1077 |

TABLE 15-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075745 | N/A | N/A | 59682 | 59697 | CTTCAAAAGCACGGTG | 58 | 1078 |
| 1075777 | N/A | N/A | 62196 | 62211 | TATGTGATATGGATTC | 12 | 1079 |
| 1075809 | N/A | N/A | 64257 | 64272 | TAGCAATAGAGTAACC | 13 | 1080 |
| 1075841 | N/A | N/A | 67205 | 67220 | ATTTAGGTACTCAGTA | 27 | 1081 |
| 1075873 | N/A | N/A | 70936 | 70951 | CTTGAATACTACACCA | 16 | 1082 |
| 1075905 | N/A | N/A | 73332 | 73347 | CCTGAACACAGGAGTA | 43 | 1083 |
| 1075937 | N/A | N/A | 76578 | 76593 | ACTTATATTCTCTCCG | 36 | 1084 |
| 1075969 | N/A | N/A | 80320 | 80335 | GTATTTAAGCCAAACC | 11 | 1085 |
| 1076001 | N/A | N/A | 82122 | 82137 | ACTCAAGGAACCATTT | 24 | 1086 |
| 1076033 | N/A | N/A | 84540 | 84555 | CATTAGTAGGTATTTC | 8 | 1087 |
| 1076065 | N/A | N/A | 86761 | 86776 | CTTTAGTAACACGAAT | 36 | 1088 |
| 1076097 | N/A | N/A | 90316 | 90331 | CAATAATAAACGATTC | 70 | 1089 |
| 1076129 | N/A | N/A | 92131 | 92146 | CATAAACCTTAGTCCT | 26 | 1090 |
| 1076161 | N/A | N/A | 93145 | 93160 | TCTTATACTAGTACGG | 14 | 1091 |
| 1076193 | N/A | N/A | 96059 | 96074 | TTAATACACAGGTTCC | 29 | 1092 |
| 1076225 | N/A | N/A | 97727 | 97742 | ATATAAACCTTGCTAC | 66 | 1093 |
| 1076257 | N/A | N/A | 100265 | 100280 | CTAAGAAACTCATAGT | 54 | 1094 |
| 1076289 | N/A | N/A | 103430 | 103445 | AACGGACAACTTAACA | 21 | 1095 |
| 1076321 | N/A | N/A | 105417 | 105432 | CAATATCACTTGGGCC | 63 | 1096 |
| 1076353 | N/A | N/A | 109381 | 109396 | ATTAAACATTCGGATT | 30 | 1097 |
| 1076385 | N/A | N/A | 111270 | 111285 | ATATAAGGGACTTGCT | 32 | 1098 |
| 1076417 | N/A | N/A | 113840 | 113855 | CTTTACACCGAAATGA | 42 | 1099 |
| 1076449 | N/A | N/A | 117101 | 117116 | CCTTATAATGCAATCC | 2 | 1100 |
| 1076481 | N/A | N/A | 119672 | 119687 | CTAAGTAAGGTTTCCC | 1 | 1101 |
| 1076513 | N/A | N/A | 122094 | 122109 | CATTAACACTCCTCAG | 36 | 1102 |
| 1076545 | N/A | N/A | 76624 | 76639 | AACCAACCTTCCCTAC | 68 | 1103 |

TABLE 16

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074114 | 109 | 124 | 3569 | 3584 | GAACTTTTTCCCTCCA | 30 | 1104 |
| 1074146 | 287 | 302 | 3747 | 3762 | GAAGCGGCGACGGCTG | 91 | 1105 |
| 1074178 | 366 | 381 | 3826 | 3841 | GCCTCCCCCGACGCGC | 95 | 1106 |

TABLE 16-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074210 | 641 | 656 | 4101 | 4116 | TCCGGAGCCTCATGGG | 113 | 1107 |
| 1074242 | 925 | 940 | 7359 | 7374 | AGAAGATGTCTTTGCC | 56 | 1108 |
| 1074274 | 1132 | 1147 | 79073 | 79088 | GTTCTTATGGTTTATA | 4 | 1109 |
| 1074306 | 1363 | 1378 | 99065 | 99080 | CCTCACCTGCCGAAGC | 107 | 1110 |
| 1074338 | 1476 | 1491 | 116665 | 116680 | GGATTTTGAGTCCCAC | 77 | 1111 |
| 1074370 | 1674 | 1689 | N/A | N/A | TTGATAGTATCACCTG | 8 | 1112 |
| 1074402 | 1971 | 1986 | 122996 | 123011 | TTATGGAAATTTCCGG | 25 | 1113 |
| 1074434 | 2264 | 2279 | 123289 | 123304 | ACTTCTAAGTCTGAGT | 51* | 1114 |
| 1074466 | 2651 | 2666 | 123676 | 123691 | ACCGACCCTGCCAAAA | 32 | 1115 |
| 1074498 | 2745 | 2760 | 123770 | 123785 | ACAATAACCATCCCAA | 17 | 1116 |
| 1074530 | 3021 | 3036 | 124046 | 124061 | CTAAACTACTTCAAAC | 88 | 1117 |
| 1074562 | 3177 | 3192 | 124202 | 124217 | GAATTCCAATCGAGAC | 30 | 1118 |
| 1074594 | 3370 | 3385 | 124395 | 124410 | TAGGAGCAAGTCTTGT | 6 | 1119 |
| 1074626 | 3730 | 3745 | 124755 | 124770 | CTGTTATGAACCCTTG | 5 | 1120 |
| 1074658 | 4023 | 4038 | 125048 | 125063 | GGCCATTTCCCCCCAG | 89 | 1121 |
| 1074690 | 4226 | 4241 | 125251 | 125266 | CCTCCCCCTAAGCTAA | 81 | 1122 |
| 1074722 | 4405 | 4420 | 125430 | 125445 | AGGAAGATCTCCATAT | 57 | 1123 |
| 1074754 | 4598 | 4613 | 125623 | 125638 | CTTTTACATTAGGAAC | 11 | 1124 |
| 1074786 | 4760 | 4775 | 125785 | 125800 | AACCATAAGTAGATCT | 28 | 1125 |
| 1074818 | 5035 | 5050 | 126060 | 126075 | ACTGAATATTGCCACC | 12 | 1126 |
| 1074850 | 5142 | 5157 | 126167 | 126182 | TTGTTATGATAGGCAC | 5 | 1127 |
| 1074914 | N/A | N/A | 5529 | 5544 | TTACATCCCGAGTGGG | 97 | 1128 |
| 1074946 | N/A | N/A | 5625 | 5640 | CCAAAACCCTTTGGTC | 109 | 1129 |
| 1074978 | N/A | N/A | 126492 | 126507 | TTGCCAGTTCTTGTTC | 38 | 1130 |
| 1075010 | N/A | N/A | 5288 | 5303 | AATAATCGAACATTGT | 88 | 1131 |
| 1075042 | N/A | N/A | 7676 | 7691 | TTAAAGGTTTGGCAC | 17 | 1132 |
| 1075074 | N/A | N/A | 9744 | 9759 | TATAGTAAGACTAATC | 105 | 1133 |
| 1075106 | N/A | N/A | 11112 | 11127 | CAAATTATAAGGTCCT | 10 | 1134 |
| 1075138 | N/A | N/A | 13444 | 13459 | AATAATAGATACTGCC | 4 | 1135 |
| 1075170 | N/A | N/A | 17299 | 17314 | ACTAAAATCCCCAAGG | 94 | 1136 |
| 1075202 | N/A | N/A | 21884 | 21899 | AATTATATAAGGCTGT | 26 | 1137 |
| 1075234 | N/A | N/A | 24701 | 24716 | GTAAATACTCTAGTTC | 22 | 1138 |
| 1075266 | N/A | N/A | 27425 | 27440 | TATTAGGACAAAGTAC | 57 | 1139 |
| 1075298 | N/A | N/A | 30895 | 30910 | ATCTCGGAAATTTAAA | 128 | 1140 |
| 1075330 | N/A | N/A | 32458 | 32473 | GAGGGAAAACTTTGCA | 63 | 1141 |
| 1075362 | N/A | N/A | 34134 | 34149 | CAGGAAAAATCTAGGT | 50 | 1142 |
| 1075394 | N/A | N/A | 36170 | 36185 | TCTTAACCTATGCCAA | 27 | 1143 |

TABLE 16-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
| --- | --- | --- | --- | --- | --- | --- | --- |
| 1075426 | N/A | N/A | 38752 | 38767 | GTATTATTAATCCTGT | 49 | 1144 |
| 1075458 | N/A | N/A | 40971 | 40986 | CCACAATATACTCCAA | 7 | 1145 |
| 1075490 | N/A | N/A | 42884 | 42899 | CATATACGCAATTAGT | 27 | 1146 |
| 1075522 | N/A | N/A | 45428 | 45443 | CAAATCGAGGCGAATC | 82 | 1147 |
| 1075554 | N/A | N/A | 47574 | 47589 | TTGCAATAGTCACCCA | 56 | 1148 |
| 1075586 | N/A | N/A | 49373 | 49388 | TATTAGCACCTGGGTA | 64 | 1149 |
| 1075618 | N/A | N/A | 51375 | 51390 | TTTTAAGAACGACATA | 69 | 1150 |
| 1075650 | N/A | N/A | 52783 | 52798 | ATATTACAATCCCAGC | 48 | 1151 |
| 1075682 | N/A | N/A | 55172 | 55187 | GATAATTATTACCCCT | 35 | 1152 |
| 1075714 | N/A | N/A | 57577 | 57592 | AATTACAATCAACCTT | 42 | 1153 |
| 1075746 | N/A | N/A | 59700 | 59715 | GATTAACCCAGTAGAG | 28 | 1154 |
| 1075778 | N/A | N/A | 62239 | 62254 | CATTTATACCAGGCAC | 3 | 1155 |
| 1075810 | N/A | N/A | 64258 | 64273 | GTAGCAATAGAGTAAC | 7 | 1156 |
| 1075842 | N/A | N/A | 67207 | 67222 | GTATTTAGGTACTCAG | 2 | 1157 |
| 1075874 | N/A | N/A | 71096 | 71111 | CTTAACAACCCTACGA | 113 | 1158 |
| 1075906 | N/A | N/A | 73792 | 73807 | CCTCAATACAGATGAA | 39 | 1159 |
| 1075938 | N/A | N/A | 76754 | 76769 | GAATATATGGGTTTCA | 55 | 1160 |
| 1075970 | N/A | N/A | 80333 | 80348 | GCTTAAAAGGACAGTA | 34 | 1161 |
| 1076002 | N/A | N/A | 82141 | 82156 | ATTTAATGGCTTGCAT | 21 | 1162 |
| 1076034 | N/A | N/A | 84970 | 84985 | AATTAGAAACTTGGCC | 74 | 1163 |
| 1076066 | N/A | N/A | 87168 | 87183 | CATATAAGATGTTTGC | 8 | 1164 |
| 1076098 | N/A | N/A | 90319 | 90334 | TTACAATAATAAACGA | 94 | 1165 |
| 1076130 | N/A | N/A | 92149 | 92164 | CTGGAATAGTGGGTGC | 34 | 1166 |
| 1076162 | N/A | N/A | 93320 | 93335 | ATTTACTTGGCAACTC | 9 | 1167 |
| 1076194 | N/A | N/A | 96060 | 96075 | TTTAATACACAGGTTC | 22 | 1168 |
| 1076226 | N/A | N/A | 97728 | 97743 | CATATAAACCTTGCTA | 36 | 1169 |
| 1076258 | N/A | N/A | 100563 | 100578 | CTTTAGGTGCCTCCTT | 10 | 1170 |
| 1076290 | N/A | N/A | 103434 | 103449 | CTCCAACGGACAACTT | 28 | 1171 |
| 1076322 | N/A | N/A | 106041 | 106056 | ATTTACAAGTGAGCAC | 21 | 1172 |
| 1076354 | N/A | N/A | 109382 | 109397 | GATTAAACATTCGGAT | 13 | 1173 |
| 1076386 | N/A | N/A | 111389 | 111404 | AGTTATAACAGTGTAA | 7 | 1174 |
| 1076418 | N/A | N/A | 113873 | 113888 | TATAATAACCCATTGT | 63 | 1175 |
| 1076450 | N/A | N/A | 117136 | 117151 | CTTGAATAGCTATGTG | 13 | 1176 |
| 1076482 | N/A | N/A | 119679 | 119694 | CTTTAGACTAAGTAAG | 107 | 1177 |
| 1076514 | N/A | N/A | 122224 | 122239 | CCTTAGGAGATGCACC | 18 | 1178 |
| 1076546 | N/A | N/A | 79333 | 79348 | CCCCAACCTGAGGAGC | 94 | 1179 |

TABLE 17

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 3 | 810 |
| 1074115 | 110 | 125 | 3570 | 3585 | AGAACTTTTTCCCTCC | 33 | 1180 |
| 1074147 | 288 | 303 | 3748 | 3763 | AGAAGCGGCGACGGCT | 23 | 1181 |
| 1074179 | 383 | 398 | 3843 | 3858 | CGGGATCCATGGCTTC | 49 | 1182 |
| 1074211 | 643 | 658 | 4103 | 4118 | CTTCCGGAGCCTCATG | 67 | 1183 |
| 1074243 | 932 | 947 | 7366 | 7381 | TCTGACCAGAAGATGT | 60 | 1184 |
| 1074275 | 1146 | 1161 | 79087 | 79102 | CAAGAGGTGGTCTTGT | 73 | 1185 |
| 1074307 | 1367 | 1382 | 99069 | 99084 | GTGGCCTCACCTGCCG | 105 | 1186 |
| 1074339 | 1479 | 1494 | 116668 | 116683 | ACTGGATTTTGAGTCC | 31 | 1187 |
| 1074371 | 1675 | 1690 | 122700 | 122715 | GTTGATAGTATCACCT | 31 | 1188 |
| 1074403 | 1973 | 1988 | 122998 | 123013 | GCTTATGGAAATTTCC | 9 | 1189 |
| 1074435 | 2265 | 2280 | 123290 | 123305 | GACTTCTAAGTCTGAG | 19* | 1190 |
| 1074467 | 2652 | 2667 | 123677 | 123692 | CACCGACCCTGCCAAA | 31 | 1191 |
| 1074499 | 2746 | 2761 | 123771 | 123786 | TACAATAACCATCCCA | 10 | 1192 |
| 1074531 | 3023 | 3038 | 124048 | 124063 | CACTAAACTACTTCAA | 73 | 1193 |
| 1074563 | 3178 | 3193 | 124203 | 124218 | TGAATTCCAATCGAGA | 4 | 1194 |
| 1074595 | 3376 | 3391 | 124401 | 124416 | TAGAAGTAGGAGCAAG | 4 | 1195 |
| 1074627 | 3731 | 3746 | 124756 | 124771 | CCTGTTATGAACCCTT | 3 | 1196 |
| 1074659 | 4042 | 4057 | 125067 | 125082 | CTAAAACTCCATCTGC | 12 | 1197 |
| 1074691 | 4227 | 4242 | 125252 | 125267 | CCCTCCCCCTAAGCTA | 76 | 1198 |
| 1074723 | 4410 | 4425 | 125435 | 125450 | GGTAAAGGAAGATCTC | 6 | 1199 |
| 1074755 | 4600 | 4615 | 125625 | 125640 | CACTTTTACATTAGGA | 3 | 1200 |
| 1074787 | 4761 | 4776 | 125786 | 125801 | CAACCATAAGTAGATC | 13 | 1201 |
| 1074819 | 5039 | 5054 | 126064 | 126079 | AAGCACTGAATATTGC | 33 | 1202 |
| 1074851 | 5143 | 5158 | 126168 | 126183 | ATTGTTATGATAGGCA | 6 | 1203 |
| 1074915 | N/A | N/A | 5531 | 5546 | AGTTACATCCCGAGTG | 65 | 1204 |
| 1074947 | N/A | N/A | 5626 | 5641 | TCCAAAACCCTTTGGT | 99 | 1205 |
| 1074979 | N/A | N/A | 126493 | 126508 | ATTGCCAGTTCTTGTT | 32 | 1206 |
| 1075011 | N/A | N/A | 5292 | 5307 | GCACAATAATCGAACA | 44 | 1207 |
| 1075043 | N/A | N/A | 7834 | 7849 | CCCCAAAAGCCCTACT | 73 | 1208 |
| 1075075 | N/A | N/A | 9942 | 9957 | AATTTTATAAGCCCAC | 9 | 1209 |
| 1075107 | N/A | N/A | 11251 | 11266 | TAAAACATTGTGGCC | 114 | 1210 |
| 1075139 | N/A | N/A | 13448 | 13463 | CCCAATAATAGATAC | 65 | 1211 |
| 1075171 | N/A | N/A | 17320 | 17335 | CCCCAATATAAAGAAC | 88 | 1212 |
| 1075203 | N/A | N/A | 21885 | 21900 | TAATTATATAAGGCTG | 68 | 1213 |
| 1075235 | N/A | N/A | 24702 | 24717 | AGTAAATACTCTAGTT | 38 | 1214 |
| 1075267 | N/A | N/A | 27547 | 27562 | CTATTTAGAATAAGTG | 83 | 1215 |

TABLE 17-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075299 | N/A | N/A | 31204 | 31219 | GATAACCAATGCACCA | 21 | 1216 |
| 1075331 | N/A | N/A | 32471 | 32486 | GATAAACACTGCAGAG | 33 | 1217 |
| 1075363 | N/A | N/A | 34223 | 34238 | ACACAATATCAAGTCC | 25 | 1218 |
| 1075395 | N/A | N/A | 36225 | 36240 | ATGAATAAGTATGCCA | 4 | 1219 |
| 1075427 | N/A | N/A | 38797 | 38812 | TATAAGGCATCTTGGA | 60 | 1220 |
| 1075459 | N/A | N/A | 41050 | 41065 | AACCAAGGATAGTCAT | 37 | 1221 |
| 1075491 | N/A | N/A | 43058 | 43073 | GACGGAAGTTGCAAGG | 93 | 1222 |
| 1075523 | N/A | N/A | 45517 | 45532 | AATTAAGGGCCCACAA | 78 | 1223 |
| 1075555 | N/A | N/A | 47585 | 47600 | GCCAAAAATTCTTGCA | 92 | 1224 |
| 1075587 | N/A | N/A | 49375 | 49390 | CTTATTAGCACCTGGG | 50 | 1225 |
| 1075619 | N/A | N/A | 51414 | 51429 | CTTAGATACTACTTTG | 54 | 1226 |
| 1075651 | N/A | N/A | 52784 | 52799 | TATATTACAATCCCAG | 57 | 1227 |
| 1075683 | N/A | N/A | 55227 | 55242 | CTGAAAAAGTTATGCC | 56 | 1228 |
| 1075715 | N/A | N/A | 57578 | 57593 | GAATTACAATCAACCT | 12 | 1229 |
| 1075747 | N/A | N/A | 59709 | 59724 | ATTTAGCATGATTAAC | 43 | 1230 |
| 1075779 | N/A | N/A | 62290 | 62305 | GTATTACAAACTGATT | 28 | 1231 |
| 1075811 | N/A | N/A | 64261 | 64276 | ATTGTAGCAATAGAGT | 10 | 1232 |
| 1075843 | N/A | N/A | 67232 | 67247 | CATGAAATGATGGAAC | 47 | 1233 |
| 1075875 | N/A | N/A | 71097 | 71112 | ACTTAACAACCCTACG | 72 | 1234 |
| 1075907 | N/A | N/A | 73846 | 73861 | AATTACTACTGGCCAT | 55 | 1235 |
| 1075939 | N/A | N/A | 76757 | 76772 | CTTGAATATATGGGTT | 6 | 1236 |
| 1075971 | N/A | N/A | 80380 | 80395 | TATTAACATACCTCAT | 28 | 1237 |
| 1076003 | N/A | N/A | 82142 | 82157 | AATTTAATGGCTTGCA | 8 | 1238 |
| 1076035 | N/A | N/A | 84972 | 84987 | GTAATTAGAAACTTGG | 9 | 1239 |
| 1076067 | N/A | N/A | 87169 | 87184 | GCATATAAGATGTTTG | 4 | 1240 |
| 1076099 | N/A | N/A | 90414 | 90429 | CCTCAAAACTTGGATT | 41 | 1241 |
| 1076131 | N/A | N/A | 92180 | 92195 | TATTATGAGGACTGAT | 23 | 1242 |
| 1076163 | N/A | N/A | 93798 | 93813 | GATATAAGTTACCAAT | 16 | 1243 |
| 1076195 | N/A | N/A | 96248 | 96263 | AATAACATGGTTCTGT | 20 | 1244 |
| 1076227 | N/A | N/A | 97800 | 97815 | ACTTATAAGGCCAGCA | 16 | 1245 |
| 1076259 | N/A | N/A | 100700 | 100715 | ATTTAACTCCTGAAGT | 61 | 1246 |
| 1076291 | N/A | N/A | 103541 | 103556 | GATTAATGGTGGCATT | 4 | 1247 |
| 1076323 | N/A | N/A | 106043 | 106058 | CAATTTACAAGTGAGC | 5 | 1248 |
| 1076355 | N/A | N/A | 109562 | 109577 | CTACAAAAGAGCTATG | 92 | 1249 |
| 1076387 | N/A | N/A | 111398 | 111413 | TGACAACACAGTTATA | 13 | 1250 |
| 1076419 | N/A | N/A | 113874 | 113889 | ATATAATAACCCATTG | 47 | 1251 |

TABLE 17-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076451 | N/A | N/A | 117183 | 117198 | CCTTAAGAACATGAGG | 77 | 1252 |
| 1076483 | N/A | N/A | 119774 | 119789 | ACGGGAAATCATATAG | 5 | 1253 |
| 1076515 | N/A | N/A | 122246 | 122261 | CTGCAAGAATACTTTA | 30 | 1254 |
| 1076547 | N/A | N/A | 97024 | 97039 | GACCAACCTCCCTCAG | 89 | 1255 |

TABLE 18

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074116 | 111 | 126 | 3571 | 3586 | GAGAACTTTTTCCCTC | 112 | 1256 |
| 1074148 | 292 | 307 | 3752 | 3767 | GTGGAGAAGCGGCGAC | 66 | 1257 |
| 1074180 | 384 | 399 | 3844 | 3859 | CCGGGATCCATGGCTT | 86 | 1258 |
| 1074212 | 644 | 659 | 4104 | 4119 | GCTTCCGGAGCCTCAT | 53 | 1259 |
| 1074244 | 933 | 948 | 7367 | 7382 | CTCTGACCAGAAGATG | 95 | 1260 |
| 1074276 | 1147 | 1162 | 79088 | 79103 | CCAAGAGGTGGTCTTG | 87 | 1261 |
| 1074308 | 1376 | 1391 | N/A | N/A | GCATTGCCTGTGGCCT | 132 | 1262 |
| 1074340 | 1493 | 1508 | 116682 | 116697 | TCCCGGGAGAAGACAC | 120 | 1263 |
| 1074372 | 1680 | 1695 | 122705 | 122720 | CTTTGGTTGATAGTAT | 10 | 1264 |
| 1074404 | 1974 | 1989 | 122999 | 123014 | GGCTTATGGAAATTTC | 16 | 1265 |
| 1074436 | 2277 | 2292 | 123302 | 123317 | CATGAAGCATCTGACT | 31* | 1266 |
| 1074468 | 2653 | 2668 | 123678 | 123693 | CCACCGACCCTGCCAA | 34 | 1267 |
| 1074500 | 2747 | 2762 | 123772 | 123787 | CTACAATAACCATCCC | 10 | 1268 |
| 1074532 | 3026 | 3041 | 124051 | 124066 | GAACACTAAACTACTT | 59 | 1269 |
| 1074564 | 3179 | 3194 | 124204 | 124219 | CTGAATTCCAATCGAG | 4 | 1270 |
| 1074596 | 3401 | 3416 | 124426 | 124441 | TTCTATCCAGGGTCAA | 12 | 1271 |
| 1074628 | 3732 | 3747 | 124757 | 124772 | GCCTGTTATGAACCCT | 5 | 1272 |
| 1074660 | 4057 | 4072 | 125082 | 125097 | AATTTCATTACTACTC | 48 | 1273 |
| 1074692 | 4245 | 4260 | 125270 | 125285 | CCCCCCCAAACTTTCC | 101 | 1274 |
| 1074724 | 4411 | 4426 | 125436 | 125451 | GGGTAAAGGAAGATCT | 22 | 1275 |
| 1074756 | 4601 | 4616 | 125626 | 125641 | GCACTTTTACATTAGG | 3 | 1276 |
| 1074788 | 4762 | 4777 | 125787 | 125802 | TCAACCATAAGTAGAT | 25 | 1277 |
| 1074820 | 5046 | 5061 | 126071 | 126086 | AAGTGTTAAGCACTGA | 85 | 1278 |
| 1074852 | 5144 | 5159 | 126169 | 126184 | AATTGTTATGATAGGC | 4 | 1279 |
| 1074916 | N/A | N/A | 5532 | 5547 | AAGTTACATCCCGAGT | 75 | 1280 |
| 1074948 | N/A | N/A | 5630 | 5645 | GAGTTCCAAAACCCTT | 61 | 1281 |

TABLE 18 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074980 | N/A | N/A | 126494 | 126509 | TATTGCCAGTTCTTGT | 26 | 1282 |
| 1075012 | N/A | N/A | 5349 | 5364 | CTATTGGAATGTTAAC | 119 | 1283 |
| 1075044 | N/A | N/A | 7844 | 7859 | AATTAGACTCCCCCAA | 58 | 1284 |
| 1075076 | N/A | N/A | 10048 | 10063 | CATAACATCATGGAAG | 25 | 1285 |
| 1075108 | N/A | N/A | 11252 | 11267 | CTAAAAACATTGTGGC | 67 | 1286 |
| 1075140 | N/A | N/A | 13661 | 13676 | CTTTAGGTTAAGCAAT | 86 | 1287 |
| 1075172 | N/A | N/A | 17404 | 17419 | CTTTACATGAACTGAT | 14 | 1288 |
| 1075204 | N/A | N/A | 22115 | 22130 | GTTAAACACATCTCAG | 43 | 1289 |
| 1075236 | N/A | N/A | 24827 | 24842 | TATAATACCACAAAGT | 81 | 1290 |
| 1075268 | N/A | N/A | 27596 | 27611 | TATTAACCTGGAGAGT | 47 | 1291 |
| 1075300 | N/A | N/A | 31414 | 31429 | CGTGAAAAGAAAGGCC | 98 | 1292 |
| 1075332 | N/A | N/A | 32520 | 32535 | AGCGGGTTTAGAATGC | 66 | 1293 |
| 1075364 | N/A | N/A | 34293 | 34308 | CGAAAATAGTTCTCAA | 59 | 1294 |
| 1075396 | N/A | N/A | 36570 | 36585 | ATTATCGCACATACAT | 89 | 1295 |
| 1075428 | N/A | N/A | 38799 | 38814 | TATATAAGGCATCTTG | 53 | 1296 |
| 1075460 | N/A | N/A | 41053 | 41068 | AATAACCAAGGATAGT | 30 | 1297 |
| 1075492 | N/A | N/A | 43309 | 43324 | GCTAAAATGATACTTC | 29 | 1298 |
| 1075524 | N/A | N/A | 45518 | 45533 | TAATTAAGGGCCCACA | 71 | 1299 |
| 1075556 | N/A | N/A | 47618 | 47633 | TGGCAAAAGAGTGGTG | 68 | 1300 |
| 1075588 | N/A | N/A | 49376 | 49391 | ACTTATTAGCACCTGG | 27 | 1301 |
| 1075620 | N/A | N/A | 51476 | 51491 | GATGAAGAATCTATAG | 88 | 1302 |
| 1075652 | N/A | N/A | 52785 | 52800 | GTATATTACAATCCCA | 40 | 1303 |
| 1075684 | N/A | N/A | 55228 | 55243 | TCTGAAAAAGTTATGC | 78 | 1304 |
| 1075716 | N/A | N/A | 57654 | 57669 | GCCGAAATACTCTCAT | 19 | 1305 |
| 1075748 | N/A | N/A | 59723 | 59738 | GTAAATCAAGTTGCAT | 7 | 1306 |
| 1075780 | N/A | N/A | 62440 | 62455 | TATAATAATCCAGAAC | 98 | 1307 |
| 1075812 | N/A | N/A | 64470 | 64485 | CATTAAGATTTTAACC | 103 | 1308 |
| 1075844 | N/A | N/A | 67247 | 67262 | TATTAAATAAGAGCTC | 84 | 1309 |
| 1075876 | N/A | N/A | 71176 | 71191 | GTATTTATGATGATTC | 6 | 1310 |
| 1075908 | N/A | N/A | 74518 | 74533 | AATAAGGAGTAGGTGG | 50 | 1311 |
| 1075940 | N/A | N/A | 77113 | 77128 | ACTCAACAACCCCAAG | 54 | 1312 |
| 1075972 | N/A | N/A | 80426 | 80441 | TCACAAGGGCTAATTC | 22 | 1313 |
| 1076004 | N/A | N/A | 82143 | 82158 | TAATTTAATGGCTTGC | 2 | 1314 |
| 1076036 | N/A | N/A | 84973 | 84988 | CGTAATTAGAAACTTG | 19 | 1315 |
| 1076068 | N/A | N/A | 87383 | 87398 | CTAAAATGACCTTAGC | 73 | 1316 |
| 1076100 | N/A | N/A | 90552 | 90567 | AATAAGGGACTACTTT | 65 | 1317 |

TABLE 18 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076132 | N/A | N/A | 92207 | 92222 | CATCAATACTGACATC | 28 | 1318 |
| 1076164 | N/A | N/A | 93799 | 93814 | TGATATAAGTTACCAA | 50 | 1319 |
| 1076196 | N/A | N/A | 96347 | 96362 | TATCAAGGGAATTATT | 113 | 1320 |
| 1076228 | N/A | N/A | 98039 | 98054 | ATTAACCTCAGTGAGC | 69 | 1321 |
| 1076260 | N/A | N/A | 100704 | 100719 | CTTAATTTAACTCCTG | 3 | 1322 |
| 1076292 | N/A | N/A | 103572 | 103587 | TATTATTGAGTTATCC | 27 | 1323 |
| 1076324 | N/A | N/A | 106059 | 106074 | GCTCAAAAGGTCTCTC | 13 | 1324 |
| 1076356 | N/A | N/A | 109576 | 109591 | CATAATTGGACTGTCT | 99 | 1325 |
| 1076388 | N/A | N/A | 111483 | 111498 | GAAATATTCGAGAAGA | 6 | 1326 |
| 1076420 | N/A | N/A | 113876 | 113891 | CCATATAATAACCCAT | 26 | 1327 |
| 1076452 | N/A | N/A | 117193 | 117208 | GGACTATAGCCCTTAA | 16 | 1328 |
| 1076484 | N/A | N/A | 119777 | 119792 | GAAACGGGAAATCATA | 10 | 1329 |
| 1076516 | N/A | N/A | 122314 | 122329 | CATAAACATGAGTGGT | 8 | 1330 |
| 1076548 | N/A | N/A | 116744 | 116759 | CACCAACCTGTTAAGG | 106 | 1331 |

TABLE 19

Inhibition of Yap 1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074117 | 117 | 132 | 3577 | 3592 | GCGCCTGAGAACTTTT | 87 | 1332 |
| 1074149 | 298 | 313 | 3758 | 3773 | GCCGAGGTGGAGAAGC | 58 | 1333 |
| 1074181 | 385 | 400 | 3845 | 3860 | CCCGGGATCCATGGCT | 107 | 1334 |
| 1074213 | 654 | 669 | 4114 | 4129 | GAGTCGGGCAGCTTCC | 55 | 1335 |
| 1074245 | 941 | 956 | 7375 | 7390 | AGAAGTATCTCTGACC | 5 | 1336 |
| 1074277 | 1153 | 1168 | 79094 | 79109 | GTCTAGCCAAGAGGTG | 18 | 1337 |
| 1074309 | 1378 | 1393 | N/A | N/A | CCGCATTGCCTGTGGC | 80 | 1338 |
| 1074341 | 1494 | 1509 | 116683 | 116698 | ATCCCGGGAGAAGACA | 106 | 1339 |
| 1074373 | 1681 | 1696 | 122706 | 122721 | GCTTTGGTTGATAGTA | 26 | 1340 |
| 1074405 | 1991 | 2006 | 123016 | 123031 | GCCTGAAAACTGCAAC | 27 | 1341 |
| 1074437 | 2278 | 2293 | 123303 | 123318 | ACATGAAGCATCTGAC | 4* | 1342 |
| 1074469 | 2654 | 2669 | 123679 | 123694 | CCCACCGACCCTGCCA | 77 | 1343 |
| 1074501 | 2748 | 2763 | 123773 | 123788 | ACTACAATAACCATCC | 9 | 1344 |
| 1074533 | 3028 | 3043 | 124053 | 124068 | TAGAACACTAAACTAC | 80 | 1345 |
| 1074565 | 3180 | 3195 | 124205 | 124220 | ACTGAATTCCAATCGA | 5 | 1346 |

TABLE 19-continued

Inhibition of Yap 1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074597 | 3405 | 3420 | 124430 | 124445 | AGTATTCTATCCAGGG | 5 | 1347 |
| 1074629 | 3742 | 3757 | 124767 | 124782 | GAGATTTATGCCTGT | 3 | 1348 |
| 1074661 | 4058 | 4073 | 125083 | 125098 | GAATTTCATTACTACT | 36 | 1349 |
| 1074693 | 4246 | 4261 | 125271 | 125286 | CCCCCCCCAAACTTTC | 92 | 1350 |
| 1074725 | 4437 | 4452 | 125462 | 125477 | GTATAACTGGGCAAAT | 17 | 1351 |
| 1074757 | 4607 | 4622 | 125632 | 125647 | AGTTAAGCACTTTTAC | 21 | 1352 |
| 1074789 | 4763 | 4778 | 125788 | 125803 | ATCAACCATAAGTAGA | 17 | 1353 |
| 1074821 | 5049 | 5064 | 126074 | 126089 | GAAAAGTGTTAAGCAC | 18 | 1354 |
| 1074853 | 5145 | 5160 | 126170 | 126185 | CAATTGTTATGATAGG | 15 | 1355 |
| 1074917 | N/A | N/A | 5533 | 5548 | CAAGTTACATCCCGAG | 80 | 1356 |
| 1074949 | N/A | N/A | 5642 | 5657 | GTGATTTTTCTGAGT | 31 | 1357 |
| 1074981 | N/A | N/A | 126495 | 126510 | TTATTGCCAGTTCTTG | 9 | 1358 |
| 1075013 | N/A | N/A | 5768 | 5783 | CATAAACCCACTTCGA | 102 | 1359 |
| 1075045 | N/A | N/A | 7845 | 7860 | AAATTAGACTCCCCCA | 18 | 1360 |
| 1075077 | N/A | N/A | 10057 | 10072 | TATACGGTCCATAACA | 35 | 1361 |
| 1075109 | N/A | N/A | 11253 | 11268 | ACTAAAAACATTGTGG | 71 | 1362 |
| 1075141 | N/A | N/A | 13863 | 13878 | TATACGAGAAGTTGAA | 54 | 1363 |
| 1075173 | N/A | N/A | 17464 | 17479 | CTTTAGGGCAACTGTA | 22 | 1364 |
| 1075205 | N/A | N/A | 22160 | 22175 | ATTAAATGAGCACCAC | 29 | 1365 |
| 1075237 | N/A | N/A | 25230 | 25245 | GCTGAAAATGCTAACT | 105 | 1366 |
| 1075269 | N/A | N/A | 27597 | 27612 | TTATTAACCTGGAGAG | 13 | 1367 |
| 1075301 | N/A | N/A | 31460 | 31475 | CAGCAACACCTAAGGA | 92 | 1368 |
| 1075333 | N/A | N/A | 32529 | 32544 | AGTTAACAAAGCGGGT | 14 | 1369 |
| 1075365 | N/A | N/A | 34295 | 34310 | CACGAAAATAGTTCTC | 11 | 1370 |
| 1075397 | N/A | N/A | 36571 | 36586 | CATTATCGCACATACA | 79 | 1371 |
| 1075429 | N/A | N/A | 38974 | 38989 | CTTTACTATCTGGGTC | 23 | 1372 |
| 1075461 | N/A | N/A | 41056 | 41071 | CTAAATAACCAAGGAT | 64 | 1373 |
| 1075493 | N/A | N/A | 43320 | 43335 | AGACAAGGGATGCTAA | 67 | 1374 |
| 1075525 | N/A | N/A | 45519 | 45534 | TTAATTAAGGGCCCAC | 130 | 1375 |
| 1075557 | N/A | N/A | 47655 | 47670 | TATTAAGGTGGCTTAC | 57 | 1376 |
| 1075589 | N/A | N/A | 49390 | 49405 | AATTAGCAGGGCAGAC | 84 | 1377 |
| 1075621 | N/A | N/A | 51645 | 51660 | GATTAACATTGATACT | 61 | 1378 |
| 1075653 | N/A | N/A | 53476 | 53491 | CATAAACTCTGCTGTC | 58 | 1379 |
| 1075685 | N/A | N/A | 55369 | 55384 | CATAATCAAAGGGTGC | 60 | 1380 |
| 1075717 | N/A | N/A | 57665 | 57680 | CATAAATTTCAGCCGA | 10 | 1381 |
| 1075749 | N/A | N/A | 59800 | 59815 | AATTATGAATGATGGG | 4 | 1382 |

TABLE 19-continued

Inhibition of Yap 1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075781 | N/A | N/A | 62475 | 62490 | CATATATTGTGACTTC | 2 | 1383 |
| 1075813 | N/A | N/A | 64652 | 64667 | ACTAATATGCAACTCT | 4 | 1384 |
| 1075845 | N/A | N/A | 67654 | 67669 | GTGGAAAAGTATGATC | 19 | 1385 |
| 1075877 | N/A | N/A | 71248 | 71263 | CTGGAAAAGTACATTC | 28 | 1386 |
| 1075909 | N/A | N/A | 74519 | 74534 | AAATAAGGAGTAGGTG | 93 | 1387 |
| 1075941 | N/A | N/A | 77150 | 77165 | AGTCAATAGCAATCAC | 11 | 1388 |
| 1075973 | N/A | N/A | 80581 | 80596 | CCGCAACACCATTCTT | 8 | 1389 |
| 1076005 | N/A | N/A | 82193 | 82208 | GTACAAAATCTCCAGG | 69 | 1390 |
| 1076037 | N/A | N/A | 84987 | 85002 | CTTAAATTCTCTTACG | 21 | 1391 |
| 1076069 | N/A | N/A | 87384 | 87399 | TCTAAAATGACCTTAG | 118 | 1392 |
| 1076101 | N/A | N/A | 90553 | 90568 | AAATAAGGGACTACTT | 71 | 1393 |
| 1076133 | N/A | N/A | 92254 | 92269 | CATACTAATTTGGTAA | 60 | 1394 |
| 1076165 | N/A | N/A | 93923 | 93938 | CCCCAAGGACTTGCCA | 79 | 1395 |
| 1076197 | N/A | N/A | 96350 | 96365 | TATTATCAAGGGAATT | 94 | 1396 |
| 1076229 | N/A | N/A | 98040 | 98055 | AATTAACCTCAGTGAG | 91 | 1397 |
| 1076261 | N/A | N/A | 100852 | 100867 | CCCCAACAAGTTCCTG | 39 | 1398 |
| 1076293 | N/A | N/A | 103575 | 103590 | GCTTATTATTGAGTTA | 3 | 1399 |
| 1076325 | N/A | N/A | 106620 | 106635 | CTAATAATGGAAGAGT | 16 | 1400 |
| 1076357 | N/A | N/A | 109680 | 109695 | TCCAAAACTTCTTAG | 22 | 1401 |
| 1076389 | N/A | N/A | 111486 | 111501 | ATCGAAATATTCGAGA | 76 | 1402 |
| 1076421 | N/A | N/A | 113900 | 113915 | AATTATGACCTCCATG | 65 | 1403 |
| 1076453 | N/A | N/A | 117330 | 117345 | GTAATATTGCAATCTG | 1 | 1404 |
| 1076485 | N/A | N/A | 119781 | 119796 | AAACGAAACGGGAAAT | 55 | 1405 |
| 1076517 | N/A | N/A | 122329 | 122344 | CATAATAAGACTAAAC | 102 | 1406 |
| 1076549 | N/A | N/A | 117537 | 117552 | GTGCAAAATACCTTTG | 8 | 1407 |

TABLE 20

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074118 | 131 | 146 | 3591 | 3606 | CACTCGGACCTGCGGC | 66 | 1408 |
| 1074150 | 299 | 314 | 3759 | 3774 | GGCCGAGGTGGAGAAG | 85 | 1409 |
| 1074182 | 386 | 401 | 3846 | 3861 | GCCCGGGATCCATGGC | 82 | 1410 |
| 1074214 | 672 | 687 | 4132 | 4147 | TCCGGCGGCTTGAAGA | 89 | 1411 |

TABLE 20 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074246 | 942 | 957 | 7376 | 7391 | AAGAAGTATCTCTGAC | 11 | 1412 |
| 1074278 | 1158 | 1173 | 79099 | 79114 | CTTGGGTCTAGCCAAG | 31 | 1413 |
| 1074310 | 1379 | 1394 | N/A | N/A | TCCGCATTGCCTGTGG | 100 | 1414 |
| 1074342 | 1495 | 1510 | 116684 | 116699 | CATCCCGGGAGAAGAC | 56 | 1415 |
| 1074374 | 1682 | 1697 | 122707 | 122722 | TGCTTTGGTTGATAGT | 13 | 1416 |
| 1074406 | 2032 | 2047 | 123057 | 123072 | AAAGTATCTTGCTGGA | 16 | 1417 |
| 1074438 | 2279 | 2294 | 123304 | 123319 | GACATGAAGCATCTGA | 1* | 1418 |
| 1074470 | 2657 | 2672 | 123682 | 123697 | CCCCCCACCGACCCTG | 69 | 1419 |
| 1074502 | 2749 | 2764 | 123774 | 123789 | AACTACAATAACCATC | 31 | 1420 |
| 1074534 | 3041 | 3056 | 124066 | 124081 | TAATAGCTCTTTCTAG | 88 | 1421 |
| 1074566 | 3181 | 3196 | 124206 | 124221 | CACTGAATTCCAATCG | 3 | 1422 |
| 1074598 | 3410 | 3425 | 124435 | 124450 | CTTATAGTATTCTATC | 46 | 1423 |
| 1074630 | 3743 | 3758 | 124768 | 124783 | AGAGATTTTATGCCTG | 5 | 1424 |
| 1074662 | 4062 | 4077 | 125087 | 125102 | GGTAGAATTTCATTAC | 30 | 1425 |
| 1074694 | 4247 | 4262 | 125272 | 125287 | CCCCCCCCCAAACTTT | 79 | 1426 |
| 1074726 | 4438 | 4453 | 125463 | 125478 | GGTATAACTGGGCAAA | 2 | 1427 |
| 1074758 | 4608 | 4623 | 125633 | 125648 | CAGTTAAGCACTTTTA | 4 | 1428 |
| 1074790 | 4764 | 4779 | 125789 | 125804 | CATCAACCATAAGTAG | 28 | 1429 |
| 1074822 | 5051 | 5066 | 126076 | 126091 | TAGAAAAGTGTTAAGC | 25 | 1430 |
| 1074854 | 5146 | 5161 | 126171 | 126186 | ACAATTGTTATGATAG | 23 | 1431 |
| 1074918 | N/A | N/A | 5534 | 5549 | TCAAGTTACATCCCGA | 60 | 1432 |
| 1074950 | N/A | N/A | 5652 | 5667 | ATCAGGTTAAGTGATT | 120 | 1433 |
| 1074982 | N/A | N/A | 126500 | 126515 | ACCTTTTATTGCCAGT | 13 | 1434 |
| 1075014 | N/A | N/A | 6038 | 6053 | GGAGAAATAAAAGTCG | 46 | 1435 |
| 1075046 | N/A | N/A | 7846 | 7861 | AAAATTAGACTCCCCC | 12 | 1436 |
| 1075078 | N/A | N/A | 10061 | 10076 | CAACTATACGGTCCAT | 3 | 1437 |
| 1075110 | N/A | N/A | 11254 | 11269 | GACTAAAAACATTGTG | 120 | 1438 |
| 1075142 | N/A | N/A | 13865 | 13880 | GATATACGAGAAGTTG | 16 | 1439 |
| 1075174 | N/A | N/A | 17491 | 17506 | CCTGAAAAGACAGTCC | 74 | 1440 |
| 1075206 | N/A | N/A | 22161 | 22176 | TATTAAATGAGCACCA | 36 | 1441 |
| 1075238 | N/A | N/A | 25596 | 25611 | CTTAAACAGGTGCCAA | 24 | 1442 |
| 1075270 | N/A | N/A | 27599 | 27614 | CTTTATTAACCTGGAG | 18 | 1443 |
| 1075302 | N/A | N/A | 31497 | 31512 | CCTTAAAGCTTCCACC | 75 | 1444 |
| 1075334 | N/A | N/A | 32542 | 32557 | TTAATAATCTACCAGT | 60 | 1445 |
| 1075366 | N/A | N/A | 34296 | 34311 | ACACGAAAATAGTTCT | 27 | 1446 |
| 1075398 | N/A | N/A | 36612 | 36627 | TATATATGGCCCTTTA | 49 | 1447 |
| 1075430 | N/A | N/A | 39017 | 39032 | CTTAACTAACTTGACC | 96 | 1448 |

TABLE 20 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075462 | N/A | N/A | 41259 | 41274 | GTTTATAGACAAGTCA | 15 | 1449 |
| 1075494 | N/A | N/A | 43450 | 43465 | TCTCAACAATTTGCTA | 47 | 1450 |
| 1075526 | N/A | N/A | 45520 | 45535 | TTTAATTAAGGGCCCA | 110 | 1451 |
| 1075558 | N/A | N/A | 47656 | 47671 | ATATTAAGGTGGCTTA | 51 | 1452 |
| 1075590 | N/A | N/A | 49396 | 49411 | CATCAAAATTAGCAGG | 50 | 1453 |
| 1075622 | N/A | N/A | 51771 | 51786 | TCTTATACCTATCTTC | 56 | 1454 |
| 1075654 | N/A | N/A | 53501 | 53516 | TATTAAGACGAATCCA | 76 | 1455 |
| 1075686 | N/A | N/A | 55578 | 55593 | GTAATTACAGTGTCTC | 10 | 1456 |
| 1075718 | N/A | N/A | 57703 | 57718 | CCACTAAAACCAAGTT | 48 | 1457 |
| 1075750 | N/A | N/A | 59801 | 59816 | CAATTATGAATGATGG | 10 | 1458 |
| 1075782 | N/A | N/A | 62506 | 62521 | TATTAGGTTTCCCGTT | 10 | 1459 |
| 1075814 | N/A | N/A | 64821 | 64836 | TATAAAGCAGGGCATT | 47 | 1460 |
| 1075846 | N/A | N/A | 67670 | 67685 | GATTAAGAGCCTATCT | 96 | 1461 |
| 1075878 | N/A | N/A | 71286 | 71301 | GATTATCAAGTAGTTT | 35 | 1462 |
| 1075910 | N/A | N/A | 74520 | 74535 | GAAATAAGGAGTAGGT | 93 | 1463 |
| 1075942 | N/A | N/A | 77172 | 77187 | TGACTATACATGGTGA | 46 | 1464 |
| 1075974 | N/A | N/A | 80589 | 80604 | AAAAAATTCCGCAACA | 39 | 1465 |
| 1076006 | N/A | N/A | 82219 | 82234 | TTTAAACCTGAGACTC | 41 | 1466 |
| 1076038 | N/A | N/A | 85047 | 85062 | AGGCAAGAATTGGGTA | 11 | 1467 |
| 1076070 | N/A | N/A | 87434 | 87449 | ATTAGTAATGCACAGG | 6 | 1468 |
| 1076102 | N/A | N/A | 90613 | 90628 | CTTAACAAATCAGCCC | 32 | 1469 |
| 1076134 | N/A | N/A | 92267 | 92282 | GATTAGAGTTGGGCAT | 10 | 1470 |
| 1076166 | N/A | N/A | 93997 | 94012 | ATTTACACCACCGCCC | 77 | 1471 |
| 1076198 | N/A | N/A | 96351 | 96366 | CTATTATCAAGGGAAT | 81 | 1472 |
| 1076230 | N/A | N/A | 98041 | 98056 | GAATTAACCTCAGTGA | 50 | 1473 |
| 1076262 | N/A | N/A | 101120 | 101135 | AGACAATAGTCTGGGC | 41 | 1474 |
| 1076294 | N/A | N/A | 103629 | 103644 | TATATTAGTGCCCCCT | 6 | 1475 |
| 1076326 | N/A | N/A | 106621 | 106636 | GCTAATAATGGAAGAG | 4 | 1476 |
| 1076358 | N/A | N/A | 109745 | 109760 | GTTTAACAAACTTGTA | 43 | 1477 |
| 1076390 | N/A | N/A | 111487 | 111502 | GATCGAAATATTCGAG | 54 | 1478 |
| 1076422 | N/A | N/A | 113901 | 113916 | GAATTATGACCTCCAT | 13 | 1479 |
| 1076454 | N/A | N/A | 117469 | 117484 | TAAACTAATCCCATAT | 35 | 1480 |
| 1076486 | N/A | N/A | 119782 | 119797 | GAAACGAAACGGGAAA | 5 | 1481 |
| 1076518 | N/A | N/A | 122341 | 122356 | GATAAGCACCACCATA | 25 | 1482 |
| 1076550 | N/A | N/A | 120573 | 120588 | TACCAACCTGTATCCA | 61 | 1483 |

TABLE 21

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074119 | 132 | 147 | 3592 | 3607 | GCACTCGGACCTGCGG | 71 | 1484 |
| 1074151 | 300 | 315 | 3760 | 3775 | GGGCCGAGGTGGAGAA | 81 | 1485 |
| 1074183 | 407 | 422 | 3867 | 3882 | CCGGTTGAGGCGGCGG | 90 | 1486 |
| 1074215 | 674 | 689 | 4134 | 4149 | GCTCCGGCGGCTTGAA | 77 | 1487 |
| 1074247 | 955 | 970 | N/A | N/A | ATCGATGTGATTTAAG | 43 | 1488 |
| 1074279 | 1165 | 1180 | 79106 | 79121 | GTCAAGCCTTGGGTCT | 13 | 1489 |
| 1074311 | 1380 | 1395 | N/A | N/A | TTCCGCATTGCCTGTG | 24 | 1490 |
| 1074343 | 1498 | 1513 | 116687 | 116702 | AGACATCCCGGGAGAA | 18 | 1491 |
| 1074375 | 1688 | 1703 | 122713 | 122728 | GCAGGGTGCTTTGGTT | 33 | 1492 |
| 1074407 | 2033 | 2048 | 123058 | 123073 | TAAAGTATCTTGCTGG | 6 | 1493 |
| 1074439 | 2283 | 2298 | 123308 | 123323 | CTGTGACATGAAGCAT | 2* | 1494 |
| 1074471 | 2658 | 2673 | 123683 | 123698 | CCCCCCCACCGACCCT | 69 | 1495 |
| 1074503 | 2750 | 2765 | 123775 | 123790 | CAACTACAATAACCAT | 29 | 1496 |
| 1074535 | 3042 | 3057 | 124067 | 124082 | GTAATAGCTCTTTCTA | 5 | 1497 |
| 1074567 | 3189 | 3204 | 124214 | 124229 | AACCTACTCACTGAAT | 38 | 1498 |
| 1074599 | 3423 | 3438 | 124448 | 124463 | GCTAACTCAAAACCTT | 12 | 1499 |
| 1074631 | 3765 | 3780 | 124790 | 124805 | CATAGCAGCTTTTGCC | 9 | 1500 |
| 1074663 | 4069 | 4084 | 125094 | 125109 | CATTCTAGGTAGAATT | 79 | 1501 |
| 1074695 | 4266 | 4281 | 125291 | 125306 | CCCCCTAAATCTTCAC | 49 | 1502 |
| 1074727 | 4440 | 4455 | 125465 | 125480 | GAGGTATAACTGGGCA | 9 | 1503 |
| 1074759 | 4619 | 4634 | 125644 | 125659 | CAACCAAGAAGCAGTT | 43 | 1504 |
| 1074791 | 4767 | 4782 | 125792 | 125807 | CTCCATCAACCATAAG | 20 | 1505 |
| 1074823 | 5080 | 5095 | 126105 | 126120 | GAGCACTCATTTCTCA | 77 | 1506 |
| 1074855 | 5213 | 5228 | 126238 | 126253 | GTGCATTAAAGAATTC | 29 | 1507 |
| 1074887 | N/A | N/A | 5450 | 5465 | TAGCCTGAAGCAAGTT | 57 | 1508 |
| 1074919 | N/A | N/A | 5535 | 5550 | CTCAAGTTACATCCCG | 48 | 1509 |
| 1074951 | N/A | N/A | 5653 | 5668 | CATCAGGTTAAGTGAT | 85 | 1510 |
| 1074983 | N/A | N/A | 126501 | 126516 | CACCTTTTATTGCCAG | 11 | 1511 |
| 1075015 | N/A | N/A | 6067 | 6082 | CAGAATAAGTATGATT | 55 | 1512 |
| 1075047 | N/A | N/A | 7847 | 7862 | TAAAATTAGACTCCCC | 7 | 1513 |
| 1075079 | N/A | N/A | 10149 | 10164 | CACCAAAAGCTTAGTT | 40 | 1514 |
| 1075111 | N/A | N/A | 11385 | 11400 | TAGGAATATGGGTAGT | 5 | 1515 |
| 1075143 | N/A | N/A | 13883 | 13898 | CCTTATTAGTCAGTTC | 2 | 1516 |
| 1075175 | N/A | N/A | 17507 | 17522 | ACTGAAAGATTCCATG | 99 | 1517 |
| 1075207 | N/A | N/A | 22162 | 22177 | CTATTAAATGAGCACC | 4 | 1518 |
| 1075239 | N/A | N/A | 25597 | 25612 | TCTTAAACAGGTGCCA | 27 | 1519 |

TABLE 21-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075271 | N/A | N/A | 27652 | 27667 | GATGTGATCTGTGAGA | 11 | 1520 |
| 1075303 | N/A | N/A | 31554 | 31569 | TAAACTAATCTACAAC | 100 | 1521 |
| 1075335 | N/A | N/A | 32543 | 32558 | CTTAATAATCTACCAG | 30 | 1522 |
| 1075367 | N/A | N/A | 34502 | 34517 | CATTACTTAGGGCTTA | 12 | 1523 |
| 1075399 | N/A | N/A | 36614 | 36629 | CATATATATGGCCCTT | 15 | 1524 |
| 1075431 | N/A | N/A | 39045 | 39060 | TAACTAAACTGATTCC | 74 | 1525 |
| 1075463 | N/A | N/A | 41370 | 41385 | CTTAATCCAAAGCTTC | 34 | 1526 |
| 1075495 | N/A | N/A | 43489 | 43504 | CTTAATTGGTAACTGA | 19 | 1527 |
| 1075527 | N/A | N/A | 45521 | 45536 | ATTTAATTAAGGGCCC | 82 | 1528 |
| 1075559 | N/A | N/A | 47657 | 47672 | GATATTAAGGTGGCTT | 24 | 1529 |
| 1075591 | N/A | N/A | 49541 | 49556 | GTAATAATCACCTTAC | 76 | 1530 |
| 1075623 | N/A | N/A | 51815 | 51830 | CATAATCAAAATGGGC | 48 | 1531 |
| 1075655 | N/A | N/A | 53502 | 53517 | CTATTAAGACGAATCC | 38 | 1532 |
| 1075687 | N/A | N/A | 55642 | 55657 | TAAACGAGTAATGACT | 23 | 1533 |
| 1075719 | N/A | N/A | 58015 | 58030 | CTAAAACCGGCTGGAC | 76 | 1534 |
| 1075751 | N/A | N/A | 59839 | 59854 | GAGGAACAAGATCTCA | 72 | 1535 |
| 1075783 | N/A | N/A | 62684 | 62699 | CTTAATTTACCTGAAC | 36 | 1536 |
| 1075815 | N/A | N/A | 64822 | 64837 | GTATAAAGCAGGGCAT | 36 | 1537 |
| 1075847 | N/A | N/A | 67823 | 67838 | CTTTATAGCAGATGCC | 14 | 1538 |
| 1075879 | N/A | N/A | 71353 | 71368 | GAATAAAGAAGTCACC | 77 | 1539 |
| 1075911 | N/A | N/A | 74637 | 74652 | TGACAAAACAGGCACC | 41 | 1540 |
| 1075943 | N/A | N/A | 77361 | 77376 | GTATATCAAACCTTTT | 15 | 1541 |
| 1075975 | N/A | N/A | 80592 | 80607 | GGAAAAAAATTCCGCA | 84 | 1542 |
| 1076007 | N/A | N/A | 82293 | 82308 | CATTAGGCCTTTTACT | 27 | 1543 |
| 1076039 | N/A | N/A | 85200 | 85215 | GATTAGAGCTGTATTC | 29 | 1544 |
| 1076071 | N/A | N/A | 87435 | 87450 | TATTAGTAATGCACAG | 14 | 1545 |
| 1076103 | N/A | N/A | 90614 | 90629 | GCTTAACAAATCAGCC | 79 | 1546 |
| 1076135 | N/A | N/A | 92319 | 92334 | CATAATTGACAGGTAT | 14 | 1547 |
| 1076167 | N/A | N/A | 93999 | 94014 | AAATTTACACCACCGC | 33 | 1548 |
| 1076199 | N/A | N/A | 96382 | 96397 | TATCAAAAGTCCATCC | 37 | 1549 |
| 1076231 | N/A | N/A | 98106 | 98121 | TTAGAAATGGACTGGG | 16 | 1550 |
| 1076263 | N/A | N/A | 101298 | 101313 | AATAACCAAGTGAGTT | 21 | 1551 |
| 1076295 | N/A | N/A | 103630 | 103645 | GTATATTAGTGCCCCC | 2 | 1552 |
| 1076327 | N/A | N/A | 106694 | 106709 | GATAAGCAAGGTTCTC | 7 | 1553 |
| 1076359 | N/A | N/A | 109776 | 109791 | ATTTATCCTAGTTACC | 29 | 1554 |
| 1076391 | N/A | N/A | 111530 | 111545 | CAAATATAGTTAGCCT | 22 | 1555 |

TABLE 21-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076423 | N/A | N/A | 114068 | 114083 | CCTGAACCTTCTGGAT | 93 | 1556 |
| 1076455 | N/A | N/A | 117635 | 117650 | ACTAAATACTTTTAGC | 86 | 1557 |
| 1076487 | N/A | N/A | 119786 | 119801 | GTACGAAACGAAACGG | 21 | 1558 |
| 1076519 | N/A | N/A | 122375 | 122390 | ACACAACACGACAGCA | 31 | 1559 |
| 1076551 | N/A | N/A | 5268 | 5283 | GTGGAATAGCAGCCAT | 67 | 1560 |

TABLE 22

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074120 | 137 | 152 | 3597 | 3612 | GCGAGGCACTCGGACC | 50 | 1561 |
| 1074152 | 301 | 316 | 3761 | 3776 | CGGGCCGAGGTGGAGA | 77 | 1562 |
| 1074184 | 408 | 423 | 3868 | 3883 | GCCGGTTGAGGCGGCG | 100 | 1563 |
| 1074216 | 681 | 696 | 4141 | 4156 | GATTTGGGCTCCGGCG | 58 | 1564 |
| 1074248 | 956 | 971 | N/A | N/A | GATCGATGTGATTTAA | 29 | 1565 |
| 1074280 | 1166 | 1181 | 79107 | 79122 | GGTCAAGCCTTGGGTC | 43 | 1566 |
| 1074312 | 1383 | 1398 | 102515 | 102530 | ATATTCCGCATTGCCT | 18 | 1567 |
| 1074344 | 1500 | 1515 | 116689 | 116704 | TGAGACATCCCGGGAG | 99 | 1568 |
| 1074376 | 1706 | 1721 | 122731 | 122746 | AACGGTTCTGCTGTGA | 44 | 1569 |
| 1074408 | 2036 | 2051 | 123061 | 123076 | GATTAAAGTATCTTGC | 23 | 1570 |
| 1074440 | 2284 | 2299 | 123309 | 123324 | GCTGTGACATGAAGCA | 38* | 1571 |
| 1074472 | 2660 | 2675 | 123685 | 123700 | AACCCCCCCACCGACC | 107 | 1572 |
| 1074504 | 2804 | 2819 | 123829 | 123844 | TCGAGATTTAAATAAG | 76 | 1573 |
| 1074536 | 3043 | 3058 | 124068 | 124083 | AGTAATAGCTCTTTCT | 6 | 1574 |
| 1074568 | 3190 | 3205 | 124215 | 124230 | GAACCTACTCACTGAA | 12 | 1575 |
| 1074600 | 3425 | 3440 | 124450 | 124465 | CAGCTAACTCAAAACC | 29 | 1576 |
| 1074632 | 3766 | 3781 | 124791 | 124806 | TCATAGCAGCTTTTGC | 12 | 1577 |
| 1074664 | 4070 | 4085 | 125095 | 125110 | GCATTCTAGGTAGAAT | 49 | 1578 |
| 1074696 | 4268 | 4283 | 125293 | 125308 | GTCCCCCTAAATCTTC | 38 | 1579 |
| 1074728 | 4441 | 4456 | 125466 | 125481 | TGAGGTATAACTGGGC | 3 | 1580 |
| 1074760 | 4620 | 4635 | 125645 | 125660 | ACAACCAAGAAGCAGT | 11 | 1581 |
| 1074792 | 4776 | 4791 | 125801 | 125816 | ATCAATGTGCTCCATC | 4 | 1582 |
| 1074824 | 5083 | 5098 | 126108 | 126123 | CCTGAGCACTCATTTC | 53 | 1583 |
| 1074856 | 5223 | 5238 | 126248 | 126263 | TTTGACAAGTGTGCAT | 15 | 1584 |
| 1074888 | N/A | N/A | 5453 | 5468 | GTTTAGCCTGAAGCAA | 58 | 1585 |

TABLE 22 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074920 | N/A | N/A | 5536 | 5551 | ACTCAAGTTACATCCC | 68 | 1586 |
| 1074952 | N/A | N/A | 5661 | 5676 | GTTTTTGTCATCAGGT | 42 | 1587 |
| 1074984 | N/A | N/A | 126503 | 126518 | ATCACCTTTTATTGCC | 31 | 1588 |
| 1075016 | N/A | N/A | 6068 | 6083 | TCAGAATAAGTATGAT | 100 | 1589 |
| 1075048 | N/A | N/A | 7848 | 7863 | GTAAAATTAGACTCCC | 4 | 1590 |
| 1075080 | N/A | N/A | 10219 | 10234 | ATTACAAAGACAGCCC | 18 | 1591 |
| 1075112 | N/A | N/A | 11388 | 11403 | ATATAGGAATATGGGT | 6 | 1592 |
| 1075144 | N/A | N/A | 14659 | 14674 | ACCCTATATCCTATAT | 82 | 1593 |
| 1075176 | N/A | N/A | 17544 | 17559 | AATTACCCGGGAACTA | 70 | 1594 |
| 1075208 | N/A | N/A | 22191 | 22206 | ACTGAACACAGGCTAC | 24 | 1595 |
| 1075240 | N/A | N/A | 25749 | 25764 | TAAACGGTTTATATTC | 16 | 1596 |
| 1075272 | N/A | N/A | 28023 | 28038 | AATTAGCCAGCATGCA | 110 | 1597 |
| 1075304 | N/A | N/A | 31613 | 31628 | CACGGGTACCAGAAAA | 50 | 1598 |
| 1075336 | N/A | N/A | 32544 | 32559 | GCTTAATAATCTACCA | 32 | 1599 |
| 1075368 | N/A | N/A | 34751 | 34766 | GAGAATAAGCAATCAG | 24 | 1600 |
| 1075400 | N/A | N/A | 36641 | 36656 | TAGCAATAGTCAGGTA | 11 | 1601 |
| 1075432 | N/A | N/A | 39046 | 39061 | CTAACTAAACTGATTC | 121 | 1602 |
| 1075464 | N/A | N/A | 41448 | 41463 | CCACTAAACCACCTAA | 77 | 1603 |
| 1075496 | N/A | N/A | 43503 | 43518 | TTATATAATGCAGGCT | 22 | 1604 |
| 1075528 | N/A | N/A | 45616 | 45631 | ATCGAAGGGCAAACTC | 42 | 1605 |
| 1075560 | N/A | N/A | 47723 | 47738 | GCTAAATAAAGGTTAC | 86 | 1606 |
| 1075592 | N/A | N/A | 49542 | 49557 | CGTAATAATCACCTTA | 55 | 1607 |
| 1075624 | N/A | N/A | 51848 | 51863 | ATCTATAACCCTTATT | 91 | 1608 |
| 1075656 | N/A | N/A | 53591 | 53606 | AAAACGGTTTTTCTAA | 103 | 1609 |
| 1075688 | N/A | N/A | 55673 | 55688 | GACAATAAACATCACC | 12 | 1610 |
| 1075720 | N/A | N/A | 58458 | 58473 | CTTTACTACATATAGC | 47 | 1611 |
| 1075752 | N/A | N/A | 60020 | 60035 | CATAATTATACTGATC | 19 | 1612 |
| 1075784 | N/A | N/A | 62703 | 62718 | ATTTTATAGGGCCATT | 3 | 1613 |
| 1075816 | N/A | N/A | 64824 | 64839 | TAGTATAAAGCAGGGC | 7 | 1614 |
| 1075848 | N/A | N/A | 67963 | 67978 | GATTACAATGGGCAGT | 9 | 1615 |
| 1075880 | N/A | N/A | 71412 | 71427 | ATTAACTACACCACGA | 30 | 1616 |
| 1075912 | N/A | N/A | 74743 | 74758 | AGTTATACACAACCAC | 13 | 1617 |
| 1075944 | N/A | N/A | 77599 | 77614 | TATTAGGAACAGATCA | 25 | 1618 |
| 1075976 | N/A | N/A | 80964 | 80979 | ATTAAAAGTCGGGCCA | 92 | 1619 |
| 1076008 | N/A | N/A | 82386 | 82401 | AGCGAAAATAACATTA | 33 | 1620 |
| 1076040 | N/A | N/A | 85319 | 85334 | CTTAAAGAAGCACTAG | 105 | 1621 |

TABLE 22 -continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076072 | N/A | N/A | 87726 | 87741 | CACAAAAACTGGTCTG | 18 | 1622 |
| 1076104 | N/A | N/A | 90640 | 90655 | ACGAAATAGTAACTGT | 24 | 1623 |
| 1076136 | N/A | N/A | 92372 | 92387 | CAACAACCTCATGTAA | 60 | 1624 |
| 1076168 | N/A | N/A | 94000 | 94015 | CAAATTTACACCACCG | 23 | 1625 |
| 1076200 | N/A | N/A | 96417 | 96432 | GATTACACTATCAAAA | 67 | 1626 |
| 1076232 | N/A | N/A | 98125 | 98140 | GTAATACACCATTTGG | 15 | 1627 |
| 1076264 | N/A | N/A | 101302 | 101317 | ACCCAATAACCAAGTG | 40 | 1628 |
| 1076296 | N/A | N/A | 103670 | 103685 | TATAAAGACCCAATGC | 68 | 1629 |
| 1076328 | N/A | N/A | 107005 | 107020 | ACTGAACCGCTGCCTC | 33 | 1630 |
| 1076360 | N/A | N/A | 109778 | 109793 | CTATTTATCCTAGTTA | 59 | 1631 |
| 1076392 | N/A | N/A | 111564 | 111579 | TATTAATCAAATAGGG | 64 | 1632 |
| 1076424 | N/A | N/A | 114085 | 114100 | ACTTAACCTGACAGCT | 76 | 1633 |
| 1076456 | N/A | N/A | 117763 | 117778 | CTTTAAAGTGTATGTC | 2 | 1634 |
| 1076488 | N/A | N/A | 119867 | 119882 | GCCAATAAGATAAGAA | 19 | 1635 |
| 1076520 | N/A | N/A | 122407 | 122422 | AATTATATGCAGCAGC | 21 | 1636 |
| 1076552 | N/A | N/A | 11807 | 11822 | ATGTATAAATACCAGG | 7 | 1637 |

TABLE 23

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074121 | 138 | 153 | 3598 | 3613 | TGCGAGGCACTCGGAC | 87 | 1638 |
| 1074153 | 303 | 318 | 3763 | 3778 | CACGGGCCGAGGTGGA | 78 | 1639 |
| 1074185 | 409 | 424 | 3869 | 3884 | GGCCGGTTGAGGCGGC | 91 | 1640 |
| 1074217 | 682 | 697 | 4142 | 4157 | GGATTTGGGCTCCGGC | 74 | 1641 |
| 1074249 | 957 | 972 | N/A | N/A | TGATCGATGTGATTTA | 23 | 1642 |
| 1074281 | 1169 | 1184 | 79110 | 79125 | GAGGGTCAAGCCTTGG | 91 | 1643 |
| 1074313 | 1385 | 1400 | 102517 | 102532 | TGATATTCCGCATTGC | 5 | 1644 |
| 1074345 | 1533 | 1548 | 116722 | 116737 | TCTGAGCTATTGGTCG | 8 | 1645 |
| 1074377 | 1707 | 1722 | 122732 | 122747 | AAACGGTTCTGCTGTG | 52 | 1646 |
| 1074409 | 2037 | 2052 | 123062 | 123077 | GGATTAAAGTATCTTG | 6 | 1647 |
| 1074441 | 2294 | 2309 | 123319 | 123334 | CAAACTAAATGCTGTG | 5* | 1648 |
| 1074473 | 2661 | 2676 | 123686 | 123701 | CAACCCCCCACCGAC | 82 | 1649 |
| 1074505 | 2806 | 2821 | 123831 | 123846 | AATCGAGATTTAAATA | 83 | 1650 |
| 1074537 | 3044 | 3059 | 124069 | 124084 | CAGTAATAGCTCTTTC | 3 | 1651 |

TABLE 23-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074569 | 3191 | 3206 | 124216 | 124231 | TGAACCTACTCACTGA | 8 | 1652 |
| 1074601 | 3426 | 3441 | 124451 | 124466 | CCAGCTAACTCAAAAC | 24 | 1653 |
| 1074633 | 3774 | 3789 | 124799 | 124814 | GAGGCTTTTCATAGCA | 78 | 1654 |
| 1074665 | 4072 | 4087 | 125097 | 125112 | TTGCATTCTAGGTAGA | 17 | 1655 |
| 1074697 | 4274 | 4289 | 125299 | 125314 | ATCAAGGTCCCCCTAA | 44 | 1656 |
| 1074729 | 4445 | 4460 | 125470 | 125485 | ACACTGAGGTATAACT | 9 | 1657 |
| 1074761 | 4628 | 4643 | 125653 | 125668 | TACCCAATACAACCAA | 15 | 1658 |
| 1074793 | 4777 | 4792 | 125802 | 125817 | AATCAATGTGCTCCAT | 9 | 1659 |
| 1074825 | 5084 | 5099 | 126109 | 126124 | ACCTGAGCACTCATTT | 36 | 1660 |
| 1074857 | 5245 | 5260 | 126270 | 126285 | ACATTGGTACTATATA | 25 | 1661 |
| 1074889 | N/A | N/A | 5454 | 5469 | AGTTTAGCCTGAAGCA | 42 | 1662 |
| 1074921 | N/A | N/A | 5537 | 5552 | CACTCAAGTTACATCC | 65 | 1663 |
| 1074953 | N/A | N/A | 5663 | 5678 | GGGTTTTGTCATCAG | 32 | 1664 |
| 1074985 | N/A | N/A | 126504 | 126519 | AATCACCTTTTATTGC | 49 | 1665 |
| 1075017 | N/A | N/A | 6099 | 6114 | CTTAAAGTGATACACC | 19 | 1666 |
| 1075049 | N/A | N/A | 7912 | 7927 | GAAATATTGGTAAGTC | 10 | 1667 |
| 1075081 | N/A | N/A | 10220 | 10235 | GATTACAAAGACAGCC | 7 | 1668 |
| 1075113 | N/A | N/A | 11804 | 11819 | TATAAATACCAGGTAC | 67 | 1669 |
| 1075145 | N/A | N/A | 15306 | 15321 | TCCCAAAAGGAGTAGC | 58 | 1670 |
| 1075177 | N/A | N/A | 17546 | 17561 | GAAATTACCCGGGAAC | 27 | 1671 |
| 1075209 | N/A | N/A | 22213 | 22228 | CATCAACAATGGTCTA | 11 | 1672 |
| 1075241 | N/A | N/A | 25786 | 25801 | GATAATTACTAACTGA | 31 | 1673 |
| 1075273 | N/A | N/A | 28145 | 28160 | AAATTATGGTCAGGCT | 18 | 1674 |
| 1075305 | N/A | N/A | 31621 | 31636 | AAACGAAACACGGGTA | 66 | 1675 |
| 1075337 | N/A | N/A | 32561 | 32576 | GCTTATATCCTGTAAC | 48 | 1676 |
| 1075369 | N/A | N/A | 34752 | 34767 | GGAGAATAAGCAATCA | 31 | 1677 |
| 1075401 | N/A | N/A | 36720 | 36735 | CGATTAAAACACTGGT | 3 | 1678 |
| 1075433 | N/A | N/A | 39050 | 39065 | TTAACTAACTAAACTG | 124 | 1679 |
| 1075465 | N/A | N/A | 41471 | 41486 | GATTTATTGAACTGAG | 7 | 1680 |
| 1075497 | N/A | N/A | 43504 | 43519 | ATTATATAATGCAGGC | 14 | 1681 |
| 1075529 | N/A | N/A | 45618 | 45633 | AAATCGAAGGGCAAAC | 84 | 1682 |
| 1075561 | N/A | N/A | 47742 | 47757 | GTAAGTAAGGGAACCC | 32 | 1683 |
| 1075593 | N/A | N/A | 49605 | 49620 | CATTAGAGTATGAACT | 99 | 1684 |
| 1075625 | N/A | N/A | 51849 | 51864 | AATCTATAACCCTTAT | 49 | 1685 |
| 1075657 | N/A | N/A | 53594 | 53609 | TAAAAACGGTTTTTC | 84 | 1686 |
| 1075689 | N/A | N/A | 55744 | 55759 | CAACTATACAAGGCAA | 4 | 1687 |

TABLE 23-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075721 | N/A | N/A | 58637 | 58652 | TTAAATACCTTCTAGC | 67 | 1688 |
| 1075753 | N/A | N/A | 60167 | 60182 | CTAGAACCTTTTCCAG | 65 | 1689 |
| 1075785 | N/A | N/A | 62704 | 62719 | CATTTTATAGGGCCAT | 2 | 1690 |
| 1075817 | N/A | N/A | 65591 | 65606 | CCTAAAGAAGTCTTGG | 100 | 1691 |
| 1075849 | N/A | N/A | 67996 | 68011 | CTAGAACACGCTGATG | 55 | 1692 |
| 1075881 | N/A | N/A | 71413 | 71428 | GATTAACTACACCACG | 23 | 1693 |
| 1075913 | N/A | N/A | 75193 | 75208 | CCCCTATACTTTTTGA | 46 | 1694 |
| 1075945 | N/A | N/A | 77600 | 77615 | GTATTAGGAACAGATC | 11 | 1695 |
| 1075977 | N/A | N/A | 80965 | 80980 | GATTAAAAGTCGGGCC | 73 | 1696 |
| 1076009 | N/A | N/A | 82387 | 82402 | TAGCGAAAATAACATT | 69 | 1697 |
| 1076041 | N/A | N/A | 85661 | 85676 | GTTAAAGAGTGGAAAT | 47 | 1698 |
| 1076073 | N/A | N/A | 88094 | 88109 | CTTTAAGGTCTAGTTA | 47 | 1699 |
| 1076105 | N/A | N/A | 90641 | 90656 | TACGAAATAGTAACTG | 13 | 1700 |
| 1076137 | N/A | N/A | 92375 | 92390 | CACCAACAACCTCATG | 45 | 1701 |
| 1076169 | N/A | N/A | 94082 | 94097 | CTACTATATCTTTGGG | 10 | 1702 |
| 1076201 | N/A | N/A | 96469 | 96484 | CTAAAAGACAGGGCC | 99 | 1703 |
| 1076233 | N/A | N/A | 98280 | 98295 | CCAATAAAGCAAGTAG | 13 | 1704 |
| 1076265 | N/A | N/A | 101306 | 101321 | TATTACCCAATAACCA | 9 | 1705 |
| 1076297 | N/A | N/A | 103671 | 103686 | TTATAAAGACCCAATG | 52 | 1706 |
| 1076329 | N/A | N/A | 107153 | 107168 | AATTATACTGGCTACT | 14 | 1707 |
| 1076361 | N/A | N/A | 109944 | 109959 | TGGGAAAAGCTACCAC | 87 | 1708 |
| 1076393 | N/A | N/A | 111591 | 111606 | CTTTACTTACTGGTGG | 4 | 1709 |
| 1076425 | N/A | N/A | 114175 | 114190 | CGGGAAAATTCTGGAG | 32 | 1710 |
| 1076457 | N/A | N/A | 117800 | 117815 | GAACTATAATCTTATA | 74 | 1711 |
| 1076489 | N/A | N/A | 119885 | 119900 | CAAAATAGGTGAGTCA | 2 | 1712 |
| 1076521 | N/A | N/A | 122446 | 122461 | ACTAAAGGAGTCATGA | 67 | 1713 |
| 1076553 | N/A | N/A | 37304 | 37319 | TGGGAATAATTTGGCC | 69 | 1714 |

TABLE 24

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074122 | 139 | 154 | 3599 | 3614 | CTGCGAGGCACTCGGA | 73 | 1715 |
| 1074154 | 304 | 319 | 3764 | 3779 | CCACGGGCCGAGGTGG | 100 | 1716 |
| 1074186 | 410 | 425 | 3870 | 3885 | GGGCCGGTTGAGGCGG | 74 | 1717 |

TABLE 24-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074218 | 726 | 741 | 7160 | 7175 | AGGGCTCCTGCAGTGC | 70 | 1718 |
| 1074250 | 958 | 973 | N/A | N/A | CTGATCGATGTGATTT | 6 | 1719 |
| 1074282 | 1170 | 1185 | 79111 | 79126 | CGAGGGTCAAGCCTTG | 83 | 1720 |
| 1074314 | 1387 | 1402 | 102519 | 102534 | ATTGATATTCCGCATT | 12 | 1721 |
| 1074346 | 1534 | 1549 | 116723 | 116738 | ATCTGAGCTATTGGTC | 10 | 1722 |
| 1074378 | 1708 | 1723 | 122733 | 122748 | GAAACGGTTCTGCTGT | 31 | 1723 |
| 1074410 | 2041 | 2056 | 123066 | 123081 | TAGAGGATTAAAGTAT | 32 | 1724 |
| 1074442 | 2351 | 2366 | 123376 | 123391 | GACCAGTAAATCATGT | 21 | 1725 |
| 1074474 | 2662 | 2677 | 123687 | 123702 | CCAACCCCCCACCGA | 71 | 1726 |
| 1074506 | 2807 | 2822 | 123832 | 123847 | TAATCGAGATTTAAAT | 107 | 1727 |
| 1074538 | 3049 | 3064 | 124074 | 124089 | ATCCACAGTAATAGCT | 31 | 1728 |
| 1074570 | 3192 | 3207 | 124217 | 124232 | ATGAACCTACTCACTG | 12 | 1729 |
| 1074602 | 3427 | 3442 | 124452 | 124467 | TCCAGCTAACTCAAAA | 24 | 1730 |
| 1074634 | 3777 | 3792 | 124802 | 124817 | GCTGAGGCTTTTCATA | 55 | 1731 |
| 1074666 | 4085 | 4100 | 125110 | 125125 | CATATACCCAATTTTG | 16 | 1732 |
| 1074698 | 4275 | 4290 | 125300 | 125315 | TATCAAGGTCCCCCTA | 78 | 1733 |
| 1074730 | 4463 | 4478 | 125488 | 125503 | TATCACAGTACTGCTA | 46 | 1734 |
| 1074762 | 4630 | 4645 | 125655 | 125670 | GCTACCCAATACAACC | 6 | 1735 |
| 1074794 | 4779 | 4794 | 125804 | 125819 | CAAATCAATGTGCTCC | 5 | 1736 |
| 1074826 | 5090 | 5105 | 126115 | 126130 | AAATCCACCTGAGCAC | 51 | 1737 |
| 1074858 | 5246 | 5261 | 126271 | 126286 | AACATTGGTACTATAT | 23 | 1738 |
| 1074890 | N/A | N/A | 5456 | 5471 | GAAGTTTAGCCTGAAG | 58 | 1739 |
| 1074922 | N/A | N/A | 5542 | 5557 | CTTTCCACTCAAGTTA | 87 | 1740 |
| 1074954 | N/A | N/A | 5665 | 5680 | CCGGGTTTTGTCATC | 91 | 1741 |
| 1074986 | N/A | N/A | 126511 | 126526 | CTACTGTAATCACCTT | 78 | 1742 |
| 1075018 | N/A | N/A | 6100 | 6115 | CCTTAAAGTGATACAC | 29 | 1743 |
| 1075050 | N/A | N/A | 8047 | 8062 | ACCCAACGGTCATGTT | 94 | 1744 |
| 1075082 | N/A | N/A | 10252 | 10267 | CTTTAGATACAAGAGG | 80 | 1745 |
| 1075114 | N/A | N/A | 11805 | 11820 | GTATAAATACCAGGTA | 26 | 1746 |
| 1075146 | N/A | N/A | 15570 | 15585 | GTATTAAGGGATTTTC | 8 | 1747 |
| 1075178 | N/A | N/A | 17552 | 17567 | CTGGAAGAAATTACCC | 47 | 1748 |
| 1075210 | N/A | N/A | 22314 | 22329 | GTATTTAACCTAAAC | 100 | 1749 |
| 1075242 | N/A | N/A | 25790 | 25805 | CAGGGATAATTACTAA | 7 | 1750 |
| 1075274 | N/A | N/A | 28203 | 28218 | AATAATCCAGCCTAGG | 86 | 1751 |
| 1075306 | N/A | N/A | 31622 | 31637 | TAAACGAAACACGGGT | 30 | 1752 |
| 1075338 | N/A | N/A | 32572 | 32587 | CCCAAAAACTAGCTTA | 56 | 1753 |

TABLE 24-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075370 | N/A | N/A | 34931 | 34946 | CTTACGAATCACATAT | 32 | 1754 |
| 1075402 | N/A | N/A | 36792 | 36807 | GAGCAACACAAGCATA | 45 | 1755 |
| 1075434 | N/A | N/A | 39406 | 39421 | GTAAAAGAGGTGCATC | 96 | 1756 |
| 1075466 | N/A | N/A | 41511 | 41526 | TCCAAAAACCATCAGT | 28 | 1757 |
| 1075498 | N/A | N/A | 43505 | 43520 | CATTATATAATGCAGG | 9 | 1758 |
| 1075530 | N/A | N/A | 45619 | 45634 | GAAATCGAAGGGCAAA | 30 | 1759 |
| 1075562 | N/A | N/A | 47824 | 47839 | GTATTTATGGCAACAT | 15 | 1760 |
| 1075594 | N/A | N/A | 49676 | 49691 | TGAGAATATTCCTCCC | 64 | 1761 |
| 1075626 | N/A | N/A | 51926 | 51941 | CATTAGCCAAAGCTCA | 34 | 1762 |
| 1075658 | N/A | N/A | 53595 | 53610 | GTAAAAACGGTTTTT | 103 | 1763 |
| 1075690 | N/A | N/A | 55750 | 55765 | CGTTAACAACTATACA | 33 | 1764 |
| 1075722 | N/A | N/A | 58638 | 58653 | GTTAAATACCTTCTAG | 88 | 1765 |
| 1075754 | N/A | N/A | 60230 | 60245 | CTTAAATGGCACAGTT | 20 | 1766 |
| 1075786 | N/A | N/A | 62749 | 62764 | CTATATTGATTCCAGA | 19 | 1767 |
| 1075818 | N/A | N/A | 65659 | 65674 | CATAACTTAGAACCAT | 35 | 1768 |
| 1075850 | N/A | N/A | 68030 | 68045 | CTATAGGTACTTAGAA | N.D. | 1769 |
| 1075882 | N/A | N/A | 71422 | 71437 | GAAAATCCTGATTAAC | 73 | 1770 |
| 1075914 | N/A | N/A | 75298 | 75313 | ATTTAGGATGCCTTTA | 14 | 1771 |
| 1075946 | N/A | N/A | 77683 | 77698 | GCTGAATAAGTAACTT | 20 | 1772 |
| 1075978 | N/A | N/A | 80966 | 80981 | AGATTAAAAGTCGGGC | 11 | 1773 |
| 1076010 | N/A | N/A | 82396 | 82411 | TATAAACAATAGCGAA | 44 | 1774 |
| 1076042 | N/A | N/A | 85704 | 85719 | CTTAAGCAAGAGTCCA | 35 | 1775 |
| 1076074 | N/A | N/A | 88162 | 88177 | CTAATTAGCTTTCAGC | 92 | 1776 |
| 1076106 | N/A | N/A | 90642 | 90657 | CTACGAAATAGTAACT | 77 | 1777 |
| 1076138 | SEQ ID NO: 1 | N/A | 92409 | 92424 | AGCCAACAATTTTTGG | 113 | 1778 |
| 1076170 | N/A | N/A | 94131 | 94146 | AGTAAAGAGTACTGTA | 16 | 1779 |
| 1076202 | N/A | N/A | 96470 | 96485 | TCTAAAAAGACAGGGC | 32 | 1780 |
| 1076234 | N/A | N/A | 98304 | 98319 | CCTTAATATATCCACA | 24 | 1781 |
| 1076266 | N/A | N/A | 101308 | 101323 | ATTATTACCCAATAAC | 72 | 1782 |
| 1076298 | N/A | N/A | 103672 | 103687 | GTTATAAAGACCCAAT | 10 | 1783 |
| 1076330 | N/A | N/A | 107154 | 107169 | GAATTATACTGGCTAC | 3 | 1784 |
| 1076362 | N/A | N/A | 110095 | 110110 | CCACTAAATAAAGCAG | 16 | 1785 |
| 1076394 | N/A | N/A | 111629 | 111644 | CCTAAATTAGACTTGA | 20 | 1786 |
| 1076426 | N/A | N/A | 114176 | 114191 | ACGGGAAAATTCTGGA | 9 | 1787 |
| 1076458 | N/A | N/A | 117825 | 117840 | CTTAATTAGCCTCAGT | 6 | 1788 |
| 1076490 | N/A | N/A | 119886 | 119901 | CCAAAATAGGTGAGTC | 2 | 1789 |

TABLE 24-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076522 | N/A | N/A | 122448 | 122463 | GCACTAAAGGAGTCAT | 35 | 1790 |
| 1076554 | N/A | N/A | 38773 | 38788 | TGGGAATAGTGAATTT | 30 | 1791 |

TABLE 25

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074123 | 140 | 155 | 3600 | 3615 | GCTGCGAGGCACTCGG | 72 | 1792 |
| 1074155 | 311 | 326 | 3771 | 3786 | CCCGGCTCCACGGGCC | 87 | 1793 |
| 1074187 | 439 | 454 | 3899 | 3914 | CTGCGAAGGCGGCTGC | 47 | 1794 |
| 1074219 | 730 | 745 | 7164 | 7179 | AGTCAGGGCTCCTGCA | 30 | 1795 |
| 1074251 | 959 | 974 | N/A | N/A | TCTGATCGATGTGATT | 7 | 1796 |
| 1074283 | 1174 | 1189 | 79115 | 79130 | AAAACGAGGGTCAAGC | 12 | 1797 |
| 1074315 | 1388 | 1403 | 102520 | 102535 | GATTGATATTCCGCAT | 3 | 1798 |
| 1074347 | 1546 | 1561 | 116735 | 116750 | GTTAAGGAAAGGATCT | 34 | 1799 |
| 1074379 | 1711 | 1726 | 122736 | 122751 | TGGGAAACGGTTCTGC | 20 | 1800 |
| 1074411 | 2095 | 2110 | 123120 | 123135 | TGTGAAAGAGGTCAGC | 3 | 1801 |
| 1074443 | 2354 | 2369 | 123379 | 123394 | TCAGACCAGTAAATCA | 7 | 1802 |
| 1074475 | 2663 | 2678 | 123688 | 123703 | ACCAACCCCCCACCG | 72 | 1803 |
| 1074507 | 2808 | 2823 | 123833 | 123848 | ATAATCGAGATTTAAA | 74 | 1804 |
| 1074539 | 3051 | 3066 | 124076 | 124091 | CTATCCACAGTAATAG | 62 | 1805 |
| 1074571 | 3193 | 3208 | 124218 | 124233 | TATGAACCTACTCACT | 37 | 1806 |
| 1074603 | 3428 | 3443 | 124453 | 124468 | TTCCAGCTAACTCAAA | 17 | 1807 |
| 1074635 | 3783 | 3798 | 124808 | 124823 | TCCCAAGCTGAGGCTT | 31 | 1808 |
| 1074667 | 4107 | 4122 | 125132 | 125147 | CCCAACAACATGCTAT | 15 | 1809 |
| 1074699 | 4276 | 4291 | 125301 | 125316 | CTATCAAGGTCCCCCT | 27 | 1810 |
| 1074731 | 4467 | 4482 | 125492 | 125507 | CAGGTATCACAGTACT | 19 | 1811 |
| 1074763 | 4631 | 4646 | 125656 | 125671 | TGCTACCCAATACAAC | 25 | 1812 |
| 1074795 | 4780 | 4795 | 125805 | 125820 | CCAAATCAATGTGCTC | 4 | 1813 |
| 1074827 | 5092 | 5107 | 126117 | 126132 | TAAAATCCACCTGAGC | 39 | 1814 |
| 1074859 | 5248 | 5263 | 126273 | 126288 | GTAACATTGGTACTAT | 16 | 1815 |
| 1074891 | N/A | N/A | 5457 | 5472 | TGAAGTTTAGCCTGAA | 31 | 1816 |
| 1074923 | N/A | N/A | 5556 | 5571 | GGGCGGTAACTCTTCT | 73 | 1817 |
| 1074955 | N/A | N/A | 5666 | 5681 | CCCGGGTTTTGTCAT | 93 | 1818 |

TABLE 25-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074987 | N/A | N/A | 4228 | 4243 | GCCGCGGCTCCCGAGC | 94 | 1819 |
| 1075019 | N/A | N/A | 6185 | 6200 | CATTAGAGTTTGATTA | 64 | 1820 |
| 1075051 | N/A | N/A | 8055 | 8070 | AATAAACAACCCAACG | 56 | 1821 |
| 1075083 | N/A | N/A | 10265 | 10280 | CAACAACACTCCTCTT | 54 | 1822 |
| 1075115 | N/A | N/A | 11890 | 11905 | GTATAGCCTTATTCTT | 6 | 1823 |
| 1075147 | N/A | N/A | 15583 | 15598 | TATAAACCTTACAGTA | 57 | 1824 |
| 1075179 | N/A | N/A | 18169 | 18184 | AATTAGCCGGTCCCAG | 107 | 1825 |
| 1075211 | N/A | N/A | 22668 | 22683 | AATAAGGGTCCTAAC | 91 | 1826 |
| 1075243 | N/A | N/A | 26237 | 26252 | CTTAGTAAGAATTGTC | 4 | 1827 |
| 1075275 | N/A | N/A | 28517 | 28532 | CTAGAAAGGCCATGTA | 76 | 1828 |
| 1075307 | N/A | N/A | 31624 | 31639 | ATTAAACGAAACACGG | 28 | 1829 |
| 1075339 | N/A | N/A | 32573 | 32588 | ACCCAAAAACTAGCTT | 70 | 1830 |
| 1075371 | N/A | N/A | 34942 | 34957 | CTGCAAAAGTTCTTAC | 90 | 1831 |
| 1075403 | N/A | N/A | 36942 | 36957 | CTTAATCAGGTACTAT | 18 | 1832 |
| 1075435 | N/A | N/A | 39516 | 39531 | CTTAAACGATAAAGTA | 93 | 1833 |
| 1075467 | N/A | N/A | 41522 | 41537 | CATTAATGCCATCCAA | 60 | 1834 |
| 1075499 | N/A | N/A | 43601 | 43616 | GCTAAAAAATGAGTAG | 99 | 1835 |
| 1075531 | N/A | N/A | 45685 | 45700 | CTTAATAGTTTAACCT | 66 | 1836 |
| 1075563 | N/A | N/A | 47947 | 47962 | CCATATAACCAGTTTT | 12 | 1837 |
| 1075595 | N/A | N/A | 49869 | 49884 | TATAATACATCTCCCC | 50 | 1838 |
| 1075627 | N/A | N/A | 51985 | 52000 | ATAAGATAGTCGGTTC | 19 | 1839 |
| 1075659 | N/A | N/A | 53597 | 53612 | AAGTAAAAACGGTTT | 125 | 1840 |
| 1075691 | N/A | N/A | 55841 | 55856 | CGTCAAAATTAACAGA | 46 | 1841 |
| 1075723 | N/A | N/A | 58758 | 58773 | TTATCCTATCCCTGGT | 32 | 1842 |
| 1075755 | N/A | N/A | 60231 | 60246 | ACTTAAATGGCACAGT | 73 | 1843 |
| 1075787 | N/A | N/A | 62761 | 62776 | CTTAAGGATTGGCTAT | 28 | 1844 |
| 1075819 | N/A | N/A | 65672 | 65687 | GTATATCCGTTCTCAT | 2 | 1845 |
| 1075851 | N/A | N/A | 68466 | 68481 | GCCGAATATGGGAAAA | 70 | 1846 |
| 1075883 | N/A | N/A | 71454 | 71469 | ACTAAAACCATTTGCC | 20 | 1847 |
| 1075915 | N/A | N/A | 75299 | 75314 | AATTTAGGATGCCTTT | 16 | 1848 |
| 1075947 | N/A | N/A | 78266 | 78281 | CTTTATAGGAATAGAG | 95 | 1849 |
| 1075979 | N/A | N/A | 81132 | 81147 | CATAATCCACTATGCA | 18 | 1850 |
| 1076011 | N/A | N/A | 82397 | 82412 | ATATAAACAATAGCGA | 61 | 1851 |
| 1076043 | N/A | N/A | 85727 | 85742 | CAAAAGGCTATTGAG | 36 | 1852 |
| 1076075 | N/A | N/A | 88209 | 88224 | ACACAAGGGTTGCTAA | 38 | 1853 |
| 1076107 | N/A | N/A | 90801 | 90816 | CATTACCAACTTCTTC | 23 | 1854 |
| 1076139 | N/A | N/A | 92416 | 92431 | CGAAAAAAGCCAACAA | 18 | 1855 |

TABLE 25-continued

Inhibition of Yap1 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076171 | N/A | N/A | 94134 | 94149 | ATTAGTAAAGAGTACT | 30 | 1856 |
| 1076203 | N/A | N/A | 96576 | 96591 | GTTAATACATGGCCAA | 29 | 1857 |
| 1076235 | N/A | N/A | 98318 | 98333 | TCAAAATAATCAGCCC | 34 | 1858 |
| 1076267 | N/A | N/A | 101345 | 101360 | ATTTAAGGTGCATAAG | 13 | 1859 |
| 1076299 | N/A | N/A | 103673 | 103688 | CGTTATAAAGACCCAA | 3 | 1860 |
| 1076331 | N/A | N/A | 107265 | 107280 | CATTATTCAGTAGTTG | 71 | 1861 |
| 1076363 | N/A | N/A | 110104 | 110119 | CATAAAGTCCACTAA | 72 | 1862 |
| 1076395 | N/A | N/A | 111649 | 111664 | GTAACTAACCTAAGGA | 34 | 1863 |
| 1076427 | N/A | N/A | 114212 | 114227 | CAAATTTACTGATCTC | 3 | 1864 |
| 1076459 | N/A | N/A | 117903 | 117918 | CTTCAACAAGACAGGT | 4 | 1865 |
| 1076491 | N/A | N/A | 119888 | 119903 | AGCCAAAATAGGTGAG | 12 | 1866 |
| 1076523 | N/A | N/A | 122559 | 122574 | ATTTATATCAGGTCAA | 5 | 1867 |
| 1076555 | N/A | N/A | 74684 | 74699 | TGGGAATAGTACACAG | 19 | 1868 |

TABLE 26

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074124 | 141 | 156 | 3601 | 3616 | GGCTGCGAGGCACTCG | 94 | 1869 |
| 1074156 | 329 | 344 | 3789 | 3804 | AGGGCTACGCCCGGAC | 96 | 1870 |
| 1074188 | 440 | 455 | 3900 | 3915 | GCTGCGAAGGCGGCTG | 113 | 1871 |
| 1074220 | 752 | 767 | 7186 | 7201 | AATGAGCTCGAACATG | 22 | 1872 |
| 1074252 | 997 | 1012 | 55492 | 55507 | GGACAGCATGGCCTTC | 50 | 1873 |
| 1074284 | 1175 | 1190 | 79116 | 79131 | CAAAACGAGGGTCAAG | 21 | 1874 |
| 1074316 | 1389 | 1404 | 102521 | 102536 | GGATTGATATTCCGCA | 33 | 1875 |
| 1074348 | 1578 | 1593 | 120483 | 120498 | GTACTCTCATCTCGAG | 100 | 1876 |
| 1074380 | 1714 | 1729 | 122739 | 122754 | GTCTGGGAAACGGTTC | 11 | 1877 |
| 1074412 | 2096 | 2111 | 123121 | 123136 | CTGTGAAAGAGGTCAG | 55 | 1878 |
| 1074444 | 2368 | 2383 | 123393 | 123408 | ACATTTTTGGCTTGTC | 3 | 1879 |
| 1074476 | 2685 | 2700 | 123710 | 123725 | TTCCGACAAAACCAAC | 18 | 1880 |
| 1074508 | 2818 | 2833 | 123843 | 123858 | GAGAGAGCAGATAATC | 7 | 1881 |
| 1074540 | 3052 | 3067 | 124077 | 124092 | ACTATCCACAGTAATA | 26 | 1882 |
| 1074572 | 3194 | 3209 | 124219 | 124234 | TTATGAACCTACTCAC | 17 | 1883 |
| 1074604 | 3446 | 3461 | 124471 | 124486 | TTATTAATCTGATCAC | 12 | 1884 |
| 1074636 | 3791 | 3806 | 124816 | 124831 | ATCTATCTTCCCAAGC | 56 | 1885 |
| 1074668 | 4108 | 4123 | 125133 | 125148 | TCCCAACAACATGCTA | 20 | 1886 |
| 1074700 | 4320 | 4335 | 125345 | 125360 | GTAAGACAAGTCTTTA | 26 | 1887 |
| 1074732 | 4468 | 4483 | 125493 | 125508 | CCAGGTATCACAGTAC | 30 | 1888 |
| 1074764 | 4632 | 4647 | 125657 | 125672 | ATGCTACCCAATACAA | 18 | 1889 |
| 1074796 | 4782 | 4797 | 125807 | 125822 | CTCCAAATCAATGTGC | 22 | 1890 |
| 1074828 | 5093 | 5108 | 126118 | 126133 | ATAAAATCCACCTGAG | 58 | 1891 |
| 1074860 | 5252 | 5267 | 126277 | 126292 | AAAGGTAACATTGGTA | 9 | 1892 |
| 1074892 | N/A | N/A | 5458 | 5473 | CTGAAGTTTAGCCTGA | 42 | 1893 |
| 1074924 | N/A | N/A | 5585 | 5600 | CCTGCAAATAGGAGAG | 87 | 1894 |
| 1074956 | N/A | N/A | 5667 | 5682 | ACCCGGGTTTTTGTCA | 104 | 1895 |
| 1074988 | N/A | N/A | 4324 | 4339 | ACCGCGGCGGAGTGGA | 94 | 1896 |
| 1075020 | N/A | N/A | 6193 | 6208 | TTAATTAGCATTAGAG | 30 | 1897 |
| 1075052 | N/A | N/A | 8204 | 8219 | ATATATACTTGATCCA | 3 | 1898 |
| 1075084 | N/A | N/A | 10268 | 10283 | TGACAACAACACTCCT | 9 | 1899 |
| 1075116 | N/A | N/A | 11969 | 11984 | CTTAACATTTAATGGC | 15 | 1900 |
| 1075148 | N/A | N/A | 16000 | 16015 | CGGAAAAAACACCTAG | 66 | 1901 |

TABLE 26-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
| --- | --- | --- | --- | --- | --- | --- | --- |
| 1075180 | N/A | N/A | 18759 | 18774 | TATTACTACAACCATA | 56 | 1902 |
| 1075212 | N/A | N/A | 22669 | 22684 | CAATAAAGGGTCCTAA | 76 | 1903 |
| 1075244 | N/A | N/A | 26292 | 26307 | ACCCAAAAATTCTGTG | 76 | 1904 |
| 1075276 | N/A | N/A | 28647 | 28662 | GACCAATACAATGGGA | 78 | 1905 |
| 1075308 | N/A | N/A | 31625 | 31640 | AATTAAACGAAACACG | 97 | 1906 |
| 1075340 | N/A | N/A | 32580 | 32595 | CCCGAACACCCAAAAA | 103 | 1907 |
| 1075372 | N/A | N/A | 34997 | 35012 | ATATATAGACTTGAGA | 27 | 1908 |
| 1075404 | N/A | N/A | 37268 | 37283 | ATATAACCTGAACTAA | 102 | 1909 |
| 1075436 | N/A | N/A | 39517 | 39532 | CCTTAAACGATAAAGT | 89 | 1910 |
| 1075468 | N/A | N/A | 41570 | 41585 | CACCAATACTGAGTAT | 91 | 1911 |
| 1075500 | N/A | N/A | 43668 | 43683 | TAAATTAAGCCAACAC | 26 | 1912 |
| 1075532 | N/A | N/A | 45686 | 45701 | ACTTAATAGTTTAACC | 121 | 1913 |
| 1075564 | N/A | N/A | 48028 | 48043 | ATATAACAGGCCACCA | 81 | 1914 |
| 1075596 | N/A | N/A | 49870 | 49885 | ATATAATACATCTCCC | 91 | 1915 |
| 1075628 | N/A | N/A | 52040 | 52055 | CCGCAAAATATTAATT | 118 | 1916 |
| 1075660 | N/A | N/A | 53599 | 53614 | CAAAGTAAAAACGGT | 72 | 1917 |
| 1075692 | N/A | N/A | 55999 | 56014 | TAAGAACACCATAGCA | 11 | 1918 |
| 1075724 | N/A | N/A | 58769 | 58784 | CTATCTGTCAGTTATC | 44 | 1919 |
| 1075756 | N/A | N/A | 60243 | 60258 | ATTTACCCTGCCACTT | 49 | 1920 |
| 1075788 | N/A | N/A | 62762 | 62777 | TCTTAAGGATTGGCTA | 15 | 1921 |
| 1075820 | N/A | N/A | 65896 | 65911 | TCTGAACGGGCTGTTG | 27 | 1922 |
| 1075852 | N/A | N/A | 68471 | 68486 | GATAAGCCGAATATGG | 58 | 1923 |
| 1075884 | N/A | N/A | 71468 | 71483 | ATTAGTAATGACTAAC | 116 | 1924 |
| 1075916 | N/A | N/A | 75300 | 75315 | CAATTTAGGATGCCTT | 6 | 1925 |
| 1075948 | N/A | N/A | 78306 | 78321 | GGACTAAAGAATACAG | 31 | 1926 |
| 1075980 | N/A | N/A | 81219 | 81234 | CAATATCCTACACCAT | 43 | 1927 |
| 1076012 | N/A | N/A | 82398 | 82413 | AATATAAACAATAGCG | 34 | 1928 |
| 1076044 | N/A | N/A | 85729 | 85744 | ATCAAAAAGGCTATTG | 73 | 1929 |
| 1076076 | N/A | N/A | 88372 | 88387 | TATCAATACTTTAGTC | 57 | 1930 |
| 1076108 | N/A | N/A | 90863 | 90878 | AAACAAAACCGGCTTT | 116 | 1931 |
| 1076140 | N/A | N/A | 92417 | 92432 | ACGAAAAAAGCCAACA | 28 | 1932 |
| 1076172 | N/A | N/A | 94135 | 94150 | TATTAGTAAAGAGTAC | 98 | 1933 |
| 1076204 | N/A | N/A | 96620 | 96635 | GATAATGAATCCTTGT | 11 | 1934 |
| 1076236 | N/A | N/A | 98440 | 98455 | GGAGAACCTTATTTAT | 51 | 1935 |
| 1076268 | N/A | N/A | 101514 | 101529 | GTACAATAATGCTTCC | 10 | 1936 |
| 1076300 | N/A | N/A | 103687 | 103702 | AAAAAATGGCTTCACG | 22 | 1937 |
| 1076332 | N/A | N/A | 107285 | 107300 | TATAAGGAATGGCAAC | 107 | 1938 |
| 1076364 | N/A | N/A | 110105 | 110120 | CCATAAAAGTCCACTA | 30 | 1939 |
| 1076396 | N/A | N/A | 111672 | 111687 | CTATATTTGAGCCATG | 2 | 1940 |
| 1076428 | N/A | N/A | 114406 | 114421 | ATTAAAAAGAAGCACG | 53 | 1941 |
| 1076460 | N/A | N/A | 117914 | 117929 | TAATATAGCCCCTTCA | 7 | 1942 |
| 1076492 | N/A | N/A | 120180 | 120195 | AAAAGATACCCCCAGT | 47 | 1943 |
| 1076524 | N/A | N/A | 122560 | 122575 | AATTTATATCAGGTCA | 6 | 1944 |
| 1076556 | N/A | N/A | 116991 | 117006 | GTATAGGCAGAAGCAA | 9 | 1945 |

TABLE 27

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
| --- | --- | --- | --- | --- | --- | --- | --- |
| 958499 | 2565 | 2580 | 123590 | 123605 | ATTAGAGTATGTGGCA | 2 | 810 |
| 1074125 | 160 | 175 | 3620 | 3635 | GCGGCTGCGCCTCGGG | 94 | 1946 |
| 1074157 | 333 | 348 | 3793 | 3808 | AGCGAGGGCTACGCCC | 103 | 1947 |
| 1074189 | 441 | 456 | 3901 | 3916 | GGCTGCGAAGGCGGCT | 96 | 1948 |
| 1074221 | 753 | 768 | 7187 | 7202 | GAATGAGCTCGAACAT | 6 | 1949 |
| 1074253 | 1001 | 1016 | 55496 | 55511 | TCTGGGACAGCATGGC | 11 | 1950 |
| 1074285 | 1176 | 1191 | N/A | N/A | GCAAAACGAGGGTCAA | 17 | 1951 |
| 1074317 | 1406 | 1421 | 102538 | 102553 | GAGAATTTGCTGTGCT | 12 | 1952 |
| 1074349 | 1580 | 1595 | 120485 | 120500 | CTGTACTCTCATCTCG | 30 | 1953 |
| 1074381 | 1715 | 1730 | 122740 | 122755 | AGTCTGGGAAACGGTT | 16 | 1954 |
| 1074413 | 2097 | 2112 | 123122 | 123137 | ACTGTGAAAGAGGTCA | 4 | 1955 |
| 1074445 | 2471 | 2486 | 123496 | 123511 | TGATAGCACTAGGAGG | 6 | 1956 |
| 1074477 | 2686 | 2701 | 123711 | 123726 | GTTCCGACAAAACCAA | 10 | 1957 |
| 1074509 | 2850 | 2865 | 123875 | 123890 | TGTTATGTTTGGGTGT | 5 | 1958 |
| 1074541 | 3053 | 3068 | 124078 | 124093 | CACTATCCACAGTAAT | 23 | 1959 |
| 1074573 | 3195 | 3210 | 124220 | 124235 | ATTATGAACCTACTCA | 14 | 1960 |

TABLE 27-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074605 | 3464 | 3479 | 124489 | 124504 | TCAACTACCAATATAC | 20 | 1961 |
| 1074637 | 3792 | 3807 | 124817 | 124832 | AATCTATCTTCCCAAG | 36 | 1962 |
| 1074669 | 4109 | 4124 | 125134 | 125149 | ATCCCAACAACATGCT | 13 | 1963 |
| 1074701 | 4322 | 4337 | 125347 | 125362 | GTGTAAGACAAGTCTT | 17 | 1964 |
| 1074733 | 4469 | 4484 | 125494 | 125509 | GCCAGGTATCACAGTA | 47 | 1965 |
| 1074765 | 4634 | 4649 | 125659 | 125674 | CAATGCTACCCAATAC | 34 | 1966 |
| 1074797 | 4783 | 4798 | 125808 | 125823 | ACTCCAAATCAATGTG | 31 | 1967 |
| 1074829 | 5095 | 5110 | 126120 | 126135 | GGATAAAATCCACCTG | 92 | 1968 |
| 1074861 | 5279 | 5294 | 126304 | 126319 | TGCTCTTACATCTAAA | 23 | 1969 |
| 1074893 | N/A | N/A | 5459 | 5474 | GCTGAAGTTTAGCCTG | 78 | 1970 |
| 1074925 | N/A | N/A | 5586 | 5601 | GCCTGCAAATAGGAGA | 94 | 1971 |
| 1074957 | N/A | N/A | 5668 | 5683 | AACCCGGGTTTTTGTC | 102 | 1972 |
| 1074989 | N/A | N/A | 4423 | 4438 | GAGGGAAAGCACGCCC | 105 | 1973 |
| 1075021 | N/A | N/A | 6245 | 6260 | TTACAACCTAGATTTG | 68 | 1974 |
| 1075053 | N/A | N/A | 8205 | 8220 | AATATATACTTGATCC | 4 | 1975 |
| 1075085 | N/A | N/A | 10318 | 10333 | TGCGGAAACAAGTGTA | 11 | 1976 |
| 1075117 | N/A | N/A | 12081 | 12096 | CCTCAATAGCAAGACA | 48 | 1977 |
| 1075149 | N/A | N/A | 16001 | 16016 | GCGGAAAAACACCTA | 50 | 1978 |
| 1075181 | N/A | N/A | 18762 | 18777 | TTATATTACTACAACC | 15 | 1979 |
| 1075213 | N/A | N/A | 22670 | 22685 | ACAATAAAGGGTCCTA | 33 | 1980 |
| 1075245 | N/A | N/A | 26692 | 26707 | CCTAATATGCTATTGT | 34 | 1981 |
| 1075277 | N/A | N/A | 28762 | 28777 | TTATAAGAACTGTGGC | 13 | 1982 |
| 1075309 | N/A | N/A | 31626 | 31641 | TAATTAAACGAAACAC | 110 | 1983 |
| 1075341 | N/A | N/A | 32592 | 32607 | GCTGAACAATCTCCCG | 31 | 1984 |
| 1075373 | N/A | N/A | 34998 | 35013 | TATATATAGACTTGAG | 13 | 1985 |
| 1075405 | N/A | N/A | 37270 | 37285 | CTATATAACCTGAACT | 84 | 1986 |
| 1075437 | N/A | N/A | 39572 | 39587 | TATTAGTACGAGCTAC | 85 | 1987 |
| 1075469 | N/A | N/A | 41723 | 41738 | TGATATAATGACCAAG | 25 | 1988 |
| 1075501 | N/A | N/A | 43670 | 43685 | CATAAATTAAGCCAAC | 67 | 1989 |
| 1075533 | N/A | N/A | 45730 | 45745 | GATTACTCAGCTATGT | 65 | 1990 |
| 1075565 | N/A | N/A | 48029 | 48044 | TATATAACAGGCCACC | 52 | 1991 |
| 1075597 | N/A | N/A | 49954 | 49969 | ATTAACATTTGCCCGC | 47 | 1992 |
| 1075629 | N/A | N/A | 52041 | 52056 | GCCGCAAAATATTAAT | 100 | 1993 |
| 1075661 | N/A | N/A | 53794 | 53809 | GAATAGGATACAAGCA | 74 | 1994 |
| 1075693 | N/A | N/A | 56014 | 56029 | CATTAAAAGTTGGGTT | 36 | 1995 |
| 1075725 | N/A | N/A | 58772 | 58787 | ATCCTATCTGTCAGTT | 18 | 1996 |
| 1075757 | N/A | N/A | 60324 | 60339 | CTTAATACATTATTCC | 2 | 1997 |
| 1075789 | N/A | N/A | 62993 | 63008 | AATTACAAGCTAATGC | 79 | 1998 |
| 1075821 | N/A | N/A | 66155 | 66170 | CTTAACTTCCCACTCG | 22 | 1999 |
| 1075853 | N/A | N/A | 68653 | 68668 | GAGCGATAAGCTGTAT | 72 | 2000 |
| 1075885 | N/A | N/A | 71469 | 71484 | CATTAGTAATGACTAA | 112 | 2001 |
| 1075917 | N/A | N/A | 75472 | 75487 | AGCAAAAAGTGATATG | 55 | 2002 |
| 1075949 | N/A | N/A | 78635 | 78650 | TAGGAACACCAAGGTT | 48 | 2003 |
| 1075981 | N/A | N/A | 81222 | 81237 | AAGCAATATCCTACAC | 40 | 2004 |
| 1076013 | N/A | N/A | 82644 | 82659 | GTTTAATACCTCTGAC | 76 | 2005 |
| 1076045 | N/A | N/A | 85776 | 85791 | GTGCAATAAATAGTTC | 11 | 2006 |
| 1076077 | N/A | N/A | 88420 | 88435 | GGATTAAAGTTTTCAC | 5 | 2007 |
| 1076109 | N/A | N/A | 91026 | 91041 | CTTAAATGACCAATTC | 23 | 2008 |
| 1076141 | N/A | N/A | 92418 | 92433 | TACGAAAAAAGCCAAC | 29 | 2009 |
| 1076173 | N/A | N/A | 94244 | 94259 | CAATATATCCTGAGAT | 91 | 2010 |
| 1076205 | N/A | N/A | 96783 | 96798 | TAGTATAATTCATGAC | 51 | 2011 |
| 1076237 | N/A | N/A | 98456 | 98471 | ACTAAAGGACAAAGGT | 109 | 2012 |
| 1076269 | N/A | N/A | 101560 | 101575 | GACGAAAAATATTCTT | 28 | 2013 |
| 1076301 | N/A | N/A | 104195 | 104210 | GTATAAGACCTTGGGA | 34 | 2014 |
| 1076333 | N/A | N/A | 107286 | 107301 | CTATAAGGAATGGCAA | 97 | 2015 |
| 1076365 | N/A | N/A | 110141 | 110156 | TAAGAAGGGCCAATGG | 15 | 2016 |
| 1076397 | N/A | N/A | 111675 | 111690 | AACCTATATTTGAGCC | 4 | 2017 |
| 1076429 | N/A | N/A | 114456 | 114471 | CATTACAAGCATAGGC | 26 | 2018 |
| 1076461 | N/A | N/A | 117917 | 117932 | GATTAATATAGCCCCT | 3 | 2019 |
| 1076493 | N/A | N/A | 120197 | 120212 | TGACAATAAGGGACAA | 34 | 2020 |
| 1076525 | N/A | N/A | 122561 | 122576 | GAATTTATATCAGGTC | 3 | 2021 |
| 1076557 | N/A | N/A | 55411 | 55426 | AACAAATACCAGGTTC | 111 | 2022 |

TABLE 28

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074126 | 163 | 178 | 3623 | 3638 | CTGGCGGCTGCGCCTC | 111 | 2023 |
| 1074158 | 334 | 349 | 3794 | 3809 | GAGCGAGGGCTACGCC | 72 | 2024 |
| 1074190 | 463 | 478 | 3923 | 3938 | CGGCGGGCCCTGCCCC | 114 | 2025 |
| 1074222 | 755 | 770 | 7189 | 7204 | AGGAATGAGCTCGAAC | 5 | 2026 |
| 1074254 | 1002 | 1017 | 55497 | 55512 | ATCTGGGACAGCATGG | 13 | 2027 |
| 1074286 | 1193 | 1208 | 98895 | 98910 | TGATTCTCTGGTTCAT | 32 | 2028 |
| 1074318 | 1407 | 1422 | 102539 | 102554 | GGAGAATTTGCTGTGC | 4 | 2029 |
| 1074350 | 1591 | 1606 | 120496 | 120511 | TAGTCCACTGTCTGTA | 14 | 2030 |
| 1074382 | 1719 | 1734 | 122744 | 122759 | AGGTAGTCTGGGAAAC | 8 | 2031 |
| 1074414 | 2098 | 2113 | 123123 | 123138 | AACTGTGAAAGAGGTC | 6 | 2032 |
| 1074446 | 2472 | 2487 | 123497 | 123512 | ATGATAGCACTAGGAG | 3 | 2033 |
| 1074478 | 2691 | 2706 | 123716 | 123731 | CCTAGGTTCCGACAAA | 69 | 2034 |
| 1074510 | 2878 | 2893 | 123903 | 123918 | ATACATTCCACTACCA | 10 | 2035 |
| 1074542 | 3056 | 3071 | 124081 | 124096 | AGGCACTATCCACAGT | 21 | 2036 |
| 1074574 | 3196 | 3211 | 124221 | 124236 | CATTATGAACCTACTC | 17 | 2037 |
| 1074606 | 3500 | 3515 | 124525 | 124540 | GGTATAATCATGATTA | 4 | 2038 |
| 1074638 | 3816 | 3831 | 124841 | 124856 | AGATTTTGTAATTGGG | 2 | 2039 |
| 1074670 | 4141 | 4156 | 125166 | 125181 | AAGTAGCTTTGATCTT | 49 | 2040 |
| 1074702 | 4323 | 4338 | 125348 | 125363 | GGTGTAAGACAAGTCT | 16 | 2041 |
| 1074734 | 4470 | 4485 | 125495 | 125510 | TGCCAGGTATCACAGT | 51 | 2042 |
| 1074766 | 4638 | 4653 | 125663 | 125678 | ATCCCAATGCTACCCA | 8 | 2043 |
| 1074798 | 4800 | 4815 | 125825 | 125840 | GCTTTGGAAGATCTGA | 4 | 2044 |
| 1074830 | 5097 | 5112 | 126122 | 126137 | GAGGATAAAATCCACC | 89 | 2045 |
| 1074862 | 5287 | 5302 | 126312 | 126327 | TATGAGCATGCTCTTA | 56 | 2046 |
| 1074894 | N/A | N/A | 5460 | 5475 | TGCTGAAGTTTAGCCT | 79 | 2047 |
| 1074926 | N/A | N/A | 5592 | 5607 | CAACAGGCCTGCAAAT | 111 | 2048 |
| 1074958 | N/A | N/A | 5669 | 5684 | TAACCCGGGTTTTTGT | 107 | 2049 |
| 1074990 | N/A | N/A | 4687 | 4702 | GCCGCAAAGGAAAGGG | 108 | 2050 |
| 1075022 | N/A | N/A | 6247 | 6262 | ATTTACAACCTAGATT | 91 | 2051 |
| 1075054 | N/A | N/A | 8206 | 8221 | CAATATATACTTGATC | 48 | 2052 |
| 1075086 | N/A | N/A | 10392 | 10407 | AGTTATAGACTTTGTA | 25 | 2053 |
| 1075118 | N/A | N/A | 12281 | 12296 | CTATTTACTCTGTCAC | 4 | 2054 |
| 1075150 | N/A | N/A | 16002 | 16017 | AGCGGAAAAACACCT | 35 | 2055 |
| 1075182 | N/A | N/A | 18766 | 18781 | GATATTATATTACTAC | 61 | 2056 |
| 1075214 | N/A | N/A | 22671 | 22686 | AACAATAAAGGGTCCT | 45 | 2057 |
| 1075246 | N/A | N/A | 26760 | 26775 | GATAACTAGTAACCGT | 6 | 2058 |
| 1075278 | N/A | N/A | 28866 | 28881 | TATACTAACATTCACG | 48 | 2059 |
| 1075310 | N/A | N/A | 31627 | 31642 | GTAATTAAACGAAACA | 84 | 2060 |
| 1075342 | N/A | N/A | 32636 | 32651 | ACTAAAAGGGAGTAGG | 87 | 2061 |
| 1075374 | N/A | N/A | 35122 | 35137 | GAAAATACTCCTCCTA | 27 | 2062 |
| 1075406 | N/A | N/A | 37271 | 37286 | ACTATATAACCTGAAC | 99 | 2063 |
| 1075438 | N/A | N/A | 39657 | 39672 | CATATTAGAGTTGAGG | 22 | 2064 |
| 1075470 | N/A | N/A | 41860 | 41875 | GCCAATAAGTTATCAA | 50 | 2065 |
| 1075502 | N/A | N/A | 44236 | 44251 | CTTAACATGATTCTAG | 61 | 2066 |
| 1075534 | N/A | N/A | 45787 | 45802 | ACCCAAGGACAGCACA | 53 | 2067 |
| 1075566 | N/A | N/A | 48030 | 48045 | ATATATAACAGGCCAC | 50 | 2068 |
| 1075598 | N/A | N/A | 49955 | 49970 | AATTAACATTTGCCCG | 62 | 2069 |
| 1075630 | N/A | N/A | 52052 | 52067 | TATAACCAAATGCCGC | 60 | 2070 |
| 1075662 | N/A | N/A | 53888 | 53903 | AAGGGATACAAGTGTT | 78 | 2071 |
| 1075694 | N/A | N/A | 56015 | 56030 | ACATTAAAAGTTGGGT | 11 | 2072 |
| 1075726 | N/A | N/A | 58776 | 58791 | AGTTATCCTATCTGTC | 14 | 2073 |
| 1075758 | N/A | N/A | 60403 | 60418 | GTAATTTAATAGACTA | 73 | 2074 |
| 1075790 | N/A | N/A | 63026 | 63041 | TCAGAAGAACTCCCAT | 14 | 2075 |
| 1075822 | N/A | N/A | 66205 | 66220 | CTTAGTAATTGCCCAT | 35 | 2076 |
| 1075854 | N/A | N/A | 68837 | 68852 | CTTATAATAGAGCTAA | 52 | 2077 |
| 1075886 | N/A | N/A | 71526 | 71541 | CATAACACTGAAGGTG | 60 | 2078 |
| 1075918 | N/A | N/A | 75510 | 75525 | CTTAAACTAACTGTTG | 82 | 2079 |
| 1075950 | N/A | N/A | 78649 | 78664 | TGACAATACCTTCCTA | 30 | 2080 |
| 1075982 | N/A | N/A | 81227 | 81242 | CATGAAAGCAATATCC | 23 | 2081 |
| 1076014 | N/A | N/A | 82658 | 82673 | AATCAACCTATGAGGT | 98 | 2082 |
| 1076046 | N/A | N/A | 85784 | 85799 | CTTAAATGGTGCAATA | 28 | 2083 |
| 1076078 | N/A | N/A | 89187 | 89202 | CTTTAGCCTCTATACC | 23 | 2084 |
| 1076110 | N/A | N/A | 91091 | 91106 | CTTTACCTAAATGTTG | 53 | 2085 |
| 1076142 | N/A | N/A | 92419 | 92434 | ATACGAAAAAGCCAA | 38 | 2086 |
| 1076174 | N/A | N/A | 94299 | 94314 | GATATATGGTAGCATA | 3 | 2087 |
| 1076206 | N/A | N/A | 96835 | 96850 | CAATAAACTTACCCTT | 55 | 2088 |
| 1076238 | N/A | N/A | 98513 | 98528 | GATGAATAGCTAAGAA | 30 | 2089 |
| 1076270 | N/A | N/A | 101571 | 101586 | TAACAATAGTAGACGA | 28 | 2090 |
| 1076302 | N/A | N/A | 104337 | 104352 | AATAAGCCTCACCTTT | 74 | 2091 |
| 1076334 | N/A | N/A | 107288 | 107303 | ACCTATAAGGAATGGC | 108 | 2092 |
| 1076366 | N/A | N/A | 110167 | 110182 | ATTTACATGAGAGGAG | 4 | 2093 |
| 1076398 | N/A | N/A | 111707 | 111722 | CTTGAAGGGCTATGGA | 62 | 2094 |

TABLE 28-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076430 | N/A | N/A | 114752 | 114767 | CGTTATAAGATGTGCT | 4 | 2095 |
| 1076462 | N/A | N/A | 117971 | 117986 | TCAGAAGGATATGCAG | 6 | 2096 |
| 1076494 | N/A | N/A | 120254 | 120269 | CTAATTGAAGCTGGCA | 3 | 2097 |
| 1076526 | N/A | N/A | 102684 | 102699 | GTAGAAAGATGGCTCA | 3 | 2098 |
| 1076558 | N/A | N/A | 82852 | 82867 | GCCAAATATTTAACTC | 30 | 2099 |

TABLE 29

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074127 | 171 | 186 | 3631 | 3646 | CCACTGGTCTGGCGGC | 57 | 2100 |
| 1074159 | 335 | 350 | 3795 | 3810 | CGAGCGAGGGCTACGC | 77 | 2101 |
| 1074191 | 464 | 479 | 3924 | 3939 | ACGGCGGGCCCTGCCC | 80 | 2102 |
| 1074223 | 786 | 801 | 7220 | 7235 | GAAACAGCTCCCAACT | 48 | 2103 |
| 1074255 | 1004 | 1019 | 55499 | 55514 | TCATCTGGGACAGCAT | 16 | 2104 |
| 1074287 | 1195 | 1210 | 98897 | 98912 | ACTGATTCTCTGGTTC | 11 | 2105 |
| 1074319 | 1425 | 1440 | N/A | N/A | GCTAACTCCTGACATT | 47 | 2106 |
| 1074351 | 1596 | 1611 | 120501 | 120516 | ATGCTTAGTCCACTGT | 7 | 2107 |
| 1074383 | 1722 | 1737 | 122747 | 122762 | TCAAGGTAGTCTGGGA | 40 | 2108 |
| 1074415 | 2101 | 2116 | 123126 | 123141 | GCCAACTGTGAAAGAG | 10 | 2109 |
| 1074447 | 2473 | 2488 | 123498 | 123513 | AATGATAGCACTAGGA | 4 | 2110 |
| 1074479 | 2697 | 2712 | 123722 | 123737 | CATTTGCCTAGGTTCC | 2 | 2111 |
| 1074511 | 2879 | 2894 | 123904 | 123919 | GATACATTCCACTACC | 9 | 2112 |
| 1074543 | 3059 | 3074 | 124084 | 124099 | CCTAGGCACTATCCAC | 57 | 2113 |
| 1074575 | 3197 | 3212 | 124222 | 124237 | ACATTATGAACCTACT | 14 | 2114 |
| 1074607 | 3502 | 3517 | 124527 | 124542 | AAGGTATAATCATGAT | 4 | 2115 |
| 1074639 | 3817 | 3832 | 124842 | 124857 | TAGATTTTGTAATTGG | 3 | 2116 |
| 1074671 | 4142 | 4157 | 125167 | 125182 | CAAGTAGCTTTGATCT | 8 | 2117 |
| 1074703 | 4324 | 4339 | 125349 | 125364 | CGGTGTAAGACAAGTC | 16 | 2118 |
| 1074735 | 4483 | 4498 | 125508 | 125523 | GATCAAAGCACTGTGC | 117 | 2119 |
| 1074767 | 4640 | 4655 | 125665 | 125680 | TTATCCCAATGCTACC | 12 | 2120 |
| 1074799 | 4801 | 4816 | 125826 | 125841 | TGCTTTGGAAGATCTG | 8 | 2121 |
| 1074831 | 5098 | 5113 | 126123 | 126138 | CGAGGATAAAATCCAC | 35 | 2122 |
| 1074863 | 5288 | 5303 | 126313 | 126328 | ATATGAGCATGCTCTT | 41 | 2123 |
| 1074895 | N/A | N/A | 5465 | 5480 | TCCTATGCTGAAGTTT | 60 | 2124 |
| 1074927 | N/A | N/A | 5594 | 5609 | TACAACAGGCCTGCAA | 74 | 2125 |
| 1074959 | N/A | N/A | 5670 | 5685 | TTAACCCGGGTTTTTG | 128 | 2126 |
| 1074991 | N/A | N/A | 4727 | 4742 | AATTATTTGACTCCCC | 60 | 2127 |
| 1075023 | N/A | N/A | 6249 | 6264 | GTATTTACAACCTAGA | 18 | 2128 |
| 1075055 | N/A | N/A | 8271 | 8286 | CTATTAAGTGAGCTTT | 4 | 2129 |
| 1075087 | N/A | N/A | 10400 | 10415 | TCTCAATAAGTTATAG | 39 | 2130 |
| 1075119 | N/A | N/A | 12305 | 12320 | AGGGAATATGTTAATC | 8 | 2131 |
| 1075151 | N/A | N/A | 16014 | 16029 | TTTAAAAGTACCAGCG | 60 | 2132 |
| 1075183 | N/A | N/A | 18905 | 18920 | ATTACTAAGACAGTGG | 15 | 2133 |
| 1075215 | N/A | N/A | 22672 | 22687 | AAACAATAAAGGGTCC | 44 | 2134 |
| 1075247 | N/A | N/A | 26764 | 26779 | CTAAGATAACTAGTAA | 101 | 2135 |
| 1075279 | N/A | N/A | 28867 | 28882 | CTATACTAACATTCAC | 52 | 2136 |
| 1075311 | N/A | N/A | 31628 | 31643 | AGTAATTAAACGAAAC | 100 | 2137 |
| 1075343 | N/A | N/A | 32637 | 32652 | AACTAAAAGGGAGTAG | 89 | 2138 |
| 1075375 | N/A | N/A | 35237 | 35252 | CTAAATATCAACTCCC | 35 | 2139 |
| 1075407 | N/A | N/A | 37273 | 37288 | GAACTATATAACCTGA | 32 | 2140 |
| 1075439 | N/A | N/A | 39815 | 39830 | AATTAGAGATATGGAC | 77 | 2141 |
| 1075471 | N/A | N/A | 41861 | 41876 | AGCCAATAAGTTATCA | 55 | 2142 |
| 1075503 | N/A | N/A | 44248 | 44263 | GCTGAAAAAGGGCTTA | 66 | 2143 |
| 1075535 | N/A | N/A | 45791 | 45806 | AATTACCCAAGGACAG | 53 | 2144 |
| 1075567 | N/A | N/A | 48031 | 48046 | GATATATAACAGGCCA | 65 | 2145 |
| 1075599 | N/A | N/A | 49979 | 49994 | ACCCTATAGCTTAGG | 90 | 2146 |
| 1075631 | N/A | N/A | 52055 | 52070 | CCCTATAACCAAATGC | 104 | 2147 |
| 1075663 | N/A | N/A | 53926 | 53941 | CTAAATAGGTGGTTAT | 80 | 2148 |
| 1075695 | N/A | N/A | 56025 | 56040 | GAATAACACCACATTA | 30 | 2149 |
| 1075727 | N/A | N/A | 58798 | 58813 | TTATCGGAGGCTTCGC | 31 | 2150 |
| 1075759 | N/A | N/A | 60742 | 60757 | CCTTATAAATTATGAC | 44 | 2151 |
| 1075791 | N/A | N/A | 63059 | 63074 | CTTTATCAGCCATCAC | 10 | 2152 |
| 1075823 | N/A | N/A | 66222 | 66237 | TATTAGAGGTTCCAGG | 30 | 2153 |

TABLE 29-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075855 | N/A | N/A | 68937 | 68952 | GATTTTTAGGCAGACG | 7 | 2154 |
| 1075887 | N/A | N/A | 71602 | 71617 | TATTACTTGATTGACA | 10 | 2155 |
| 1075919 | N/A | N/A | 75511 | 75526 | TCTTAAACTAACTGTT | 78 | 2156 |
| 1075951 | N/A | N/A | 78699 | 78714 | CACGGAAGAGCTTGCA | 34 | 2157 |
| 1075983 | N/A | N/A | 81249 | 81264 | ATCGAAAAGCAAACTC | 5 | 2158 |
| 1076015 | N/A | N/A | 82981 | 82996 | ATTTAGTTGGTTGTTA | 8 | 2159 |
| 1076047 | N/A | N/A | 85785 | 85800 | ACTTAAATGGTGCAAT | 34 | 2160 |
| 1076079 | N/A | N/A | 89467 | 89482 | AAGCAATATATGGCCT | 37 | 2161 |
| 1076111 | N/A | N/A | 91203 | 91218 | AATTAGTTAGGATATC | 67 | 2162 |
| 1076143 | N/A | N/A | 92420 | 92435 | GATACGAAAAAAGCCA | 8 | 2163 |
| 1076175 | N/A | N/A | 94392 | 94407 | CAATAGGTAACAGGTA | 15 | 2164 |
| 1076207 | N/A | N/A | 96838 | 96853 | AGTCAATAAACTTACC | 58 | 2165 |
| 1076239 | N/A | N/A | 98583 | 98598 | GTTTAAAAAAACGGG | 75 | 2166 |
| 1076271 | N/A | N/A | 101685 | 101700 | CGGCAACAACAAAATG | 18 | 2167 |
| 1076303 | N/A | N/A | 104339 | 104354 | CTAATAAGCCTCACCT | 34 | 2168 |
| 1076335 | N/A | N/A | 107289 | 107304 | CACCTATAAGGAATGG | 80 | 2169 |
| 1076367 | N/A | N/A | 110169 | 110184 | CTATTTACATGAGAGG | 3 | 2170 |
| 1076399 | N/A | N/A | 111771 | 111786 | GATAACTTAGAGATGT | 4 | 2171 |
| 1076431 | N/A | N/A | 114853 | 114868 | CACCAATAGAACATAT | 31 | 2172 |
| 1076463 | N/A | N/A | 118082 | 118097 | GATTAGTAACACTGAT | 38 | 2173 |
| 1076495 | N/A | N/A | 120353 | 120368 | GATTAGTGAAAATTCC | 30 | 2174 |
| 1076527 | N/A | N/A | 117218 | 117233 | GCACAACCTTACATTT | 6 | 2175 |
| 1076559 | N/A | N/A | 111532 | 111547 | AACAAATATAGTTAGC | 74 | 2176 |

TABLE 30

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074128 | 173 | 188 | 3633 | 3648 | CTCCACTGGTCTGGCG | 76 | 2177 |
| 1074160 | 336 | 351 | 3796 | 3811 | GCGAGCGAGGGCTACG | 86 | 2178 |
| 1074192 | 465 | 480 | 3925 | 3940 | GACGGCGGGCCCTGCC | 108 | 2179 |
| 1074224 | 821 | 836 | 7255 | 7270 | CAGAGACTACTCCAGT | 16 | 2180 |
| 1074256 | 1033 | 1048 | 55528 | 55543 | CACTGGTGGACTGGTG | 64 | 2181 |
| 1074288 | 1196 | 1211 | 98898 | 98913 | GACTGATTCTCTGGTT | 48 | 2182 |
| 1074320 | 1426 | 1441 | N/A | N/A | GGCTAACTCCTGACAT | 80 | 2183 |
| 1074352 | 1597 | 1612 | 120502 | 120517 | CATGCTTAGTCCACTG | 69 | 2184 |
| 1074384 | 1723 | 1738 | 122748 | 122763 | TTCAAGGTAGTCTGGG | 35 | 2185 |
| 1074416 | 2108 | 2123 | 123133 | 123148 | CTTTAGAGCCAACTGT | 9 | 2186 |
| 1074448 | 2474 | 2489 | 123499 | 123514 | TAATGATAGCACTAGG | 3 | 2187 |
| 1074480 | 2698 | 2713 | 123723 | 123738 | TCATTTGCCTAGGTTC | 3 | 2188 |
| 1074512 | 2880 | 2895 | 123905 | 123920 | GGATACATTCCACTAC | 64 | 2189 |
| 1074544 | 3063 | 3078 | 124088 | 124103 | CTCCCCTAGGCACTAT | 34 | 2190 |
| 1074576 | 3201 | 3216 | 124226 | 124241 | ATGCACATTATGAACC | 7 | 2191 |
| 1074608 | 3529 | 3544 | 124554 | 124569 | GTTACATCATCTCTTC | 5 | 2192 |
| 1074640 | 3828 | 3843 | 124853 | 124868 | GCCAAAATACTTAGAT | 26 | 2193 |
| 1074672 | 4143 | 4158 | 125168 | 125183 | CCAAGTAGCTTTGATC | 6 | 2194 |
| 1074704 | 4326 | 4341 | 125351 | 125366 | CACGGTGTAAGACAAG | 16 | 2195 |
| 1074736 | 4504 | 4519 | 125529 | 125544 | TCAGTACAGAGGGCAT | 4 | 2196 |
| 1074768 | 4641 | 4656 | 125666 | 125681 | CTTATCCCAATGCTAC | 11 | 2197 |
| 1074800 | 4808 | 4823 | 125833 | 125848 | CAAATAGTGCTTTGGA | 6 | 2198 |
| 1074832 | 5099 | 5114 | 126124 | 126139 | GCGAGGATAAAATCCA | 17 | 2199 |
| 1074864 | 5289 | 5304 | 126314 | 126329 | CATATGAGCATGCTCT | 47 | 2200 |
| 1074896 | N/A | N/A | 5472 | 5487 | GCAAAGTTCCTATGCT | 99 | 2201 |
| 1074928 | N/A | N/A | 5595 | 5610 | ATACAACAGGCCTGCA | 83 | 2202 |
| 1074960 | N/A | N/A | 5671 | 5686 | CTTAACCCGGGTTTTT | 81 | 2203 |
| 1074992 | N/A | N/A | 4728 | 4743 | CAATTATTTGACTCCC | 63 | 2204 |
| 1075024 | N/A | N/A | 6368 | 6383 | ACTGAACAAGTATCTT | 32 | 2205 |
| 1075056 | N/A | N/A | 8297 | 8312 | CTTTATTATCTCAACC | 21 | 2206 |
| 1075088 | N/A | N/A | 10433 | 10448 | ATTTATAGTCAGGTTC | 2 | 2207 |
| 1075120 | N/A | N/A | 12519 | 12534 | AATTAGCCTACCACCT | 42 | 2208 |
| 1075152 | N/A | N/A | 16101 | 16116 | TATAATGGGAGGATTA | 99 | 2209 |
| 1075184 | N/A | N/A | 18998 | 19013 | CAAGAACACTGGTATT | 67 | 2210 |
| 1075216 | N/A | N/A | 23247 | 23262 | TATTTTACACGAACTA | 55 | 2211 |
| 1075248 | N/A | N/A | 26930 | 26945 | GTACAAAAAGCGGTCG | 64 | 2212 |

TABLE 30-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075280 | N/A | N/A | 28870 | 28885 | GAACTATACTAACATT | 57 | 2213 |
| 1075312 | N/A | N/A | 31662 | 31677 | TTAATTGAACTCAGGG | 37 | 2214 |
| 1075344 | N/A | N/A | 32638 | 32653 | TAACTAAAAGGGAGTA | 91 | 2215 |
| 1075376 | N/A | N/A | 35238 | 35253 | CCTAAATATCAACTCC | 72 | 2216 |
| 1075408 | N/A | N/A | 37387 | 37402 | CTAAAATGGCATAAGG | 23 | 2217 |
| 1075440 | N/A | N/A | 39843 | 39858 | AAATTATTAGTTGTCG | 28 | 2218 |
| 1075472 | N/A | N/A | 41890 | 41905 | GATTATAGTTAAACAG | 92 | 2219 |
| 1075504 | N/A | N/A | 44291 | 44306 | CTTAAATGAGAGAACC | 71 | 2220 |
| 1075536 | N/A | N/A | 45793 | 45808 | TTAATTACCCAAGGAC | 55 | 2221 |
| 1075568 | N/A | N/A | 48108 | 48123 | TTATTTAAGTTGGGAG | 23 | 2222 |
| 1075600 | N/A | N/A | 49991 | 50006 | CACTATAATCTGACCC | 68 | 2223 |
| 1075632 | N/A | N/A | 52056 | 52071 | TCCCTATAACCAAATG | 95 | 2224 |
| 1075664 | N/A | N/A | 53927 | 53942 | GCTAAATAGGTGGTTA | 87 | 2225 |
| 1075696 | N/A | N/A | 56066 | 56081 | TTACAAAAGTTACTGC | 28 | 2226 |
| 1075728 | N/A | N/A | 58800 | 58815 | CTTTATCGGAGGCTTC | 15 | 2227 |
| 1075760 | N/A | N/A | 61106 | 61121 | GAGAAAACTACGGAT | 39 | 2228 |
| 1075792 | N/A | N/A | 63072 | 63087 | GATTAGAAAGTGCCTT | 6 | 2229 |
| 1075824 | N/A | N/A | 66223 | 66238 | GTATTAGAGGTTCCAG | 3 | 2230 |
| 1075856 | N/A | N/A | 68965 | 68980 | CCTAATCAAGTTCTGC | 40 | 2231 |
| 1075888 | N/A | N/A | 71648 | 71663 | ACTTAAACTTGAGGGA | 22 | 2232 |
| 1075920 | N/A | N/A | 75749 | 75764 | AAAGAAAGCTGCGCAC | 108 | 2233 |
| 1075952 | N/A | N/A | 78848 | 78863 | CTATATACCTGCTTCT | 41 | 2234 |
| 1075984 | N/A | N/A | 81250 | 81265 | TATCGAAAAGCAAACT | 44 | 2235 |
| 1076016 | N/A | N/A | 83002 | 83017 | TAATAGGATGGATTCT | 8 | 2236 |
| 1076048 | N/A | N/A | 85859 | 85874 | GATTAAAGGCTGGAAG | 32 | 2237 |
| 1076080 | N/A | N/A | 89574 | 89589 | CATTAGCAGTTCACTA | 55 | 2238 |
| 1076112 | N/A | N/A | 91226 | 91241 | ATTCAAAACCACGGAA | 98 | 2239 |
| 1076144 | N/A | N/A | 92435 | 92450 | TTTTATAGGGCAATGG | 7 | 2240 |
| 1076176 | N/A | N/A | 94395 | 94410 | CTCCAATAGGTAACAG | 43 | 2241 |
| 1076208 | N/A | N/A | 97037 | 97052 | GAGGAATATTACAGAC | 15 | 2242 |
| 1076240 | N/A | N/A | 98611 | 98626 | ATTAAAAGCAAGGTGC | 56 | 2243 |
| 1076272 | N/A | N/A | 101702 | 101717 | TTAGAACAACTACTAC | 53 | 2244 |
| 1076304 | N/A | N/A | 104340 | 104355 | ACTAATAAGCCTCACC | 30 | 2245 |
| 1076336 | N/A | N/A | 107295 | 107310 | CATTACCACCTATAAG | 31 | 2246 |
| 1076368 | N/A | N/A | 110251 | 110266 | CATTTTATGTAAGGCC | 15 | 2247 |
| 1076400 | N/A | N/A | 111869 | 111884 | GTTAAAAGCCGTGAAA | 10 | 2248 |
| 1076432 | N/A | N/A | 114880 | 114895 | CATTAGTATTCACTGT | 18 | 2249 |
| 1076464 | N/A | N/A | 118102 | 118117 | CATATACAATTCTGCC | 2 | 2250 |
| 1076496 | N/A | N/A | 120437 | 120452 | GTTAAAGACCAACACA | 81 | 2251 |
| 1076528 | N/A | N/A | 16102 | 16117 | TTATAATGGGAGGATT | 86 | 2252 |
| 1076560 | N/A | N/A | 113259 | 113274 | TCCAAATATGGCATAC | 10 | 2253 |

TABLE 31

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074129 | 178 | 193 | 3638 | 3653 | CCCGGCTCCACTGGTC | 77 | 2254 |
| 1074161 | 337 | 352 | 3797 | 3812 | GGCGAGCGAGGGCTAC | 98 | 2255 |
| 1074193 | 471 | 486 | 3931 | 3946 | GGTCCGGACGGCGGGC | 74 | 2256 |
| 1074225 | 822 | 837 | 7256 | 7271 | CCAGAGACTACTCCAG | 11 | 2257 |
| 1074257 | 1034 | 1049 | 55529 | 55544 | GCACTGGTGGACTGGT | 29 | 2258 |
| 1074289 | 1197 | 1212 | 98899 | 98914 | TGACTGATTCTCTGGT | 13 | 2259 |
| 1074321 | 1427 | 1442 | N/A | N/A | GGGCTAACTCCTGACA | 73 | 2260 |
| 1074353 | 1612 | 1627 | 120517 | 120532 | GACACTGTAGCTGCTC | 17 | 2261 |
| 1074385 | 1724 | 1739 | 122749 | 122764 | CTTCAAGGTAGTCTGG | 17 | 2262 |
| 1074417 | 2109 | 2124 | 123134 | 123149 | TCTTTAGAGCCAACTG | 2 | 2263 |
| 1074449 | 2475 | 2490 | 123500 | 123515 | CTAATGATAGCACTAG | 36 | 2264 |
| 1074481 | 2705 | 2720 | 123730 | 123745 | AAATATGGTCATTTGCC | 14 | 2265 |
| 1074513 | 2881 | 2896 | 123906 | 123921 | AGGATACATTCCACTA | 47 | 2266 |
| 1074545 | 3064 | 3079 | 124089 | 124104 | ACTCCCCTAGGCACTA | 18 | 2267 |

TABLE 31-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074577 | 3211 | 3226 | 124236 | 124251 | TATTTCTGTCATGCAC | 3 | 2268 |
| 1074609 | 3532 | 3547 | 124557 | 124572 | CTAGTTACATCATCTC | 8 | 2269 |
| 1074641 | 3829 | 3844 | 124854 | 124869 | GGCCAAAATACTTAGA | 107 | 2270 |
| 1074673 | 4154 | 4169 | 125179 | 125194 | AGGCACTCCTTCCAAG | 43 | 2271 |
| 1074705 | 4327 | 4342 | 125352 | 125367 | GCACGGTGTAAGACAA | 20 | 2272 |
| 1074737 | 4510 | 4525 | 125535 | 125550 | TTCAGGTCAGTACAGA | 7 | 2273 |
| 1074769 | 4642 | 4657 | 125667 | 125682 | TCTTATCCCAATGCTA | 12 | 2274 |
| 1074801 | 4809 | 4824 | 125834 | 125849 | ACAAATAGTGCTTTGG | 8 | 2275 |
| 1074833 | 5100 | 5115 | 126125 | 126140 | TGCGAGGATAAAATCC | 17 | 2276 |
| 1074865 | 5290 | 5305 | 126315 | 126330 | ACATATGAGCATGCTC | 46 | 2277 |
| 1074897 | N/A | N/A | 5473 | 5488 | GGCAAAGTTCCTATGC | 76 | 2278 |
| 1074929 | N/A | N/A | 5596 | 5611 | TATACAACAGGCCTGC | 79 | 2279 |
| 1074961 | N/A | N/A | 5676 | 5691 | TCCTCCTTAACCCGGG | 93 | 2280 |
| 1074993 | N/A | N/A | 4755 | 4770 | TCTAATCAACACTGGA | 65 | 2281 |
| 1075025 | N/A | N/A | 6468 | 6483 | ACTTAAGAACTCACAC | 58 | 2282 |
| 1075057 | N/A | N/A | 8351 | 8366 | CCTTAGGAGTAGACTG | 14 | 2283 |
| 1075089 | N/A | N/A | 10434 | 10449 | CATTTATAGTCAGGTT | 2 | 2284 |
| 1075121 | N/A | N/A | 12521 | 12536 | AAAATTAGCCTACCAC | 40 | 2285 |
| 1075153 | N/A | N/A | 16103 | 16118 | ATTATAATGGGAGGAT | 38 | 2286 |
| 1075185 | N/A | N/A | 19001 | 19016 | GCCCAAGAACACTGGT | 78 | 2287 |
| 1075217 | N/A | N/A | 23248 | 23263 | TTATTTTACACGAACT | 71 | 2288 |
| 1075249 | N/A | N/A | 27029 | 27044 | ATTACGATTAGATCAG | 5 | 2289 |
| 1075281 | N/A | N/A | 29105 | 29120 | CAGCAAAAGTACCATG | 36 | 2290 |
| 1075313 | N/A | N/A | 31663 | 31678 | CTTAATTGAACTCAGG | 28 | 2291 |
| 1075345 | N/A | N/A | 32639 | 32654 | GTAACTAAAAGGGAGT | 29 | 2292 |
| 1075377 | N/A | N/A | 35267 | 35282 | CTAGAAAGGTTGGCCC | 108 | 2293 |
| 1075409 | N/A | N/A | 37405 | 37420 | CTTTAAATAGCAGAGG | 22 | 2294 |
| 1075441 | N/A | N/A | 40002 | 40017 | GAATTAAAGCAGTGCC | 24 | 2295 |
| 1075473 | N/A | N/A | 41930 | 41945 | AGTTATAACTGTACTA | 89 | 2296 |
| 1075505 | N/A | N/A | 44322 | 44337 | GCTAAATTACAGAGGT | 18 | 2297 |
| 1075537 | N/A | N/A | 45795 | 45810 | CTTTAATTACCCAAGG | 82 | 2298 |
| 1075569 | N/A | N/A | 48125 | 48140 | GTAGAAAGGCATTAGA | 45 | 2299 |
| 1075601 | N/A | N/A | 49992 | 50007 | ACACTATAATCTGACC | 50 | 2300 |
| 1075633 | N/A | N/A | 52118 | 52133 | CTATATTGGCTCCTAG | 82 | 2301 |
| 1075665 | N/A | N/A | 53953 | 53968 | ATTTAGTTGTGCACAG | 87 | 2302 |
| 1075697 | N/A | N/A | 56110 | 56125 | AATAATCCATGCTTGC | 16 | 2303 |
| 1075729 | N/A | N/A | 58853 | 58868 | TATTTAAAAATAGCGC | 88 | 2304 |
| 1075761 | N/A | N/A | 61107 | 61122 | GGAGAAAAACTACGGA | 13 | 2305 |
| 1075793 | N/A | N/A | 63128 | 63143 | CATTAGTTGCCCTGAC | 31 | 2306 |
| 1075825 | N/A | N/A | 66353 | 66368 | CCCCTAAAGAAGATTT | 44 | 2307 |
| 1075857 | N/A | N/A | 68976 | 68991 | CTTAAACAATCCCTAA | 69 | 2308 |
| 1075889 | N/A | N/A | 72204 | 72219 | ATTAAAAGTAGGCCCT | 71 | 2309 |
| 1075921 | N/A | N/A | 75750 | 75765 | GAAAGAAAGCTGCGCA | 93 | 2310 |
| 1075953 | N/A | N/A | 78851 | 78866 | AACCTATATACCTGCT | 36 | 2311 |
| 1075985 | N/A | N/A | 81251 | 81266 | ATATCGAAAAGCAAAC | 82 | 2312 |
| 1076017 | N/A | N/A | 83003 | 83018 | CTAATAGGATGGATTC | 5 | 2313 |
| 1076049 | N/A | N/A | 85860 | 85875 | AGATTAAAGGCTGGAA | 4 | 2314 |
| 1076081 | N/A | N/A | 89730 | 89745 | GATAATTCACCCTTGT | 15 | 2315 |
| 1076113 | N/A | N/A | 91298 | 91313 | TGACAATAGCCAATGC | 16 | 2316 |
| 1076145 | N/A | N/A | 92457 | 92472 | CCTTATAGGTTATAGT | 41 | 2317 |
| 1076177 | N/A | N/A | 94422 | 94437 | CTTTATTTCCCACCCG | 37 | 2318 |
| 1076209 | N/A | N/A | 97241 | 97256 | CATTAGCACACCTTTT | 12 | 2319 |
| 1076241 | N/A | N/A | 98642 | 98657 | CAATAAGGAACAGTTT | 42 | 2320 |
| 1076273 | N/A | N/A | 101849 | 101864 | AAACAAAATGGCGAAT | 84 | 2321 |
| 1076305 | N/A | N/A | 104341 | 104356 | TACTAATAAGCCTCAC | 37 | 2322 |
| 1076337 | N/A | N/A | 107326 | 107341 | ATTAAACCAGGGACTG | 25 | 2323 |
| 1076369 | N/A | N/A | 110591 | 110606 | TATTCGGTATTTTCTA | 2 | 2324 |
| 1076401 | N/A | N/A | 112117 | 112132 | TCTAAAGACTCTCATT | 31 | 2325 |
| 1076433 | N/A | N/A | 114928 | 114943 | ATTAACTTTCGCTAAA | 69 | 2326 |
| 1076465 | N/A | N/A | 118550 | 118565 | GCTTAAGGAATATACA | 5 | 2327 |
| 1076497 | N/A | N/A | 120579 | 120594 | AAAGAATACCAACCTG | 72 | 2328 |
| 1076529 | N/A | N/A | 40252 | 40267 | CTATAATGAGGATTAC | 108 | 2329 |
| 1076561 | N/A | N/A | 11318 | 11333 | GTATACCAAGCTACTC | 22 | 2330 |

TABLE 32

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074130 | 214 | 229 | 3674 | 3689 | ATCCCCGCCCCGGCG | 119 | 2331 |
| 1074162 | 338 | 353 | 3798 | 3813 | AGGCGAGCGAGGGCTA | 101 | 2332 |
| 1074194 | 474 | 489 | 3934 | 3949 | CCGGGTCCGGACGGCG | 57 | 2333 |
| 1074226 | 859 | 874 | 7293 | 7308 | CTGTCGAAGATGCTGA | 10 | 2334 |
| 1074258 | 1044 | 1059 | 55539 | 55554 | ATATTCTGCTGCACTG | 36 | 2335 |
| 1074290 | 1198 | 1213 | 98900 | 98915 | CTGACTGATTCTCTGG | 5 | 2336 |
| 1074322 | 1428 | 1443 | N/A | N/A | AGGGCTAACTCCTGAC | 94 | 2337 |
| 1074354 | 1613 | 1628 | 120518 | 120533 | GGACACTGTAGCTGCT | 24 | 2338 |
| 1074386 | 1733 | 1748 | 122758 | 122773 | CAGGAATGGCTTCAAG | 39 | 2339 |
| 1074418 | 2110 | 2125 | 123135 | 123150 | TTCTTTAGAGCCAACT | 4 | 2340 |
| 1074450 | 2476 | 2491 | 123501 | 123516 | ACTAATGATAGCACTA | 5 | 2341 |
| 1074482 | 2706 | 2721 | 123731 | 123746 | TAATATGGTCATTTGC | 12 | 2342 |
| 1074514 | 2882 | 2897 | 123907 | 123922 | AAGGATACATTCCACT | 25 | 2343 |
| 1074546 | 3065 | 3080 | 124090 | 124105 | CACTCCCCTAGGCACT | 33 | 2344 |
| 1074578 | 3214 | 3229 | 124239 | 124254 | GCTTATTTCTGTCATG | 8 | 2345 |
| 1074610 | 3533 | 3548 | 124558 | 124573 | TCTAGTTACATCATCT | 5 | 2346 |
| 1074642 | 3830 | 3845 | 124855 | 124870 | GGGCCAAAATACTTAG | 78 | 2347 |
| 1074674 | 4157 | 4172 | 125182 | 125197 | TATAGGCACTCCTTCC | 22 | 2348 |
| 1074706 | 4336 | 4351 | 125361 | 125376 | TTAATGGCAGCACGGT | 48 | 2349 |
| 1074738 | 4511 | 4526 | 125536 | 125551 | CTTCAGGTCAGTACAG | 12 | 2350 |
| 1074770 | 4643 | 4658 | 125668 | 125683 | ATCTTATCCCAATGCT | 15 | 2351 |
| 1074802 | 4836 | 4851 | 125861 | 125876 | GGCACTACATTTAGAA | 37 | 2352 |
| 1074834 | 5101 | 5116 | 126126 | 126141 | TTGCGAGGATAAAATC | 14 | 2353 |
| 1074866 | 5291 | 5306 | 126316 | 126331 | AACATATGAGCATGCT | 30 | 2354 |
| 1074898 | N/A | N/A | 5481 | 5496 | AACTTTTGGGCAAAGT | 101 | 2355 |
| 1074930 | N/A | N/A | 5597 | 5612 | CTATACAACAGGCCTG | 84 | 2356 |
| 1074962 | N/A | N/A | 5709 | 5724 | AGGCAAGCAGCTAAAT | 78 | 2357 |
| 1074994 | N/A | N/A | 4784 | 4799 | AAACTAAATGGACCGG | 94 | 2358 |
| 1075026 | N/A | N/A | 6556 | 6571 | CTTAAAAGCCATCTAC | 55 | 2359 |
| 1075058 | N/A | N/A | 8466 | 8481 | ATTACAAAGTAGCAAC | 66 | 2360 |
| 1075090 | N/A | N/A | 10590 | 10605 | GCTTATAATCTTTCAG | 9 | 2361 |
| 1075122 | N/A | N/A | 12522 | 12537 | GAAAATTAGCCTACCA | 16 | 2362 |
| 1075154 | N/A | N/A | 16104 | 16119 | CATTATAATGGGAGGA | 13 | 2363 |
| 1075186 | N/A | N/A | 19097 | 19112 | AAATCGATTATTCAGA | 73 | 2364 |
| 1075218 | N/A | N/A | 23347 | 23362 | CTTAACACTGGTAAGA | 97 | 2365 |
| 1075250 | N/A | N/A | 27030 | 27045 | AATTACGATTAGATCA | 55 | 2366 |
| 1075282 | N/A | N/A | 29645 | 29660 | GAAAAATGAGCCCGGT | 103 | 2367 |
| 1075314 | N/A | N/A | 31708 | 31723 | AATAAAGTCTAATCCA | 54 | 2368 |
| 1075346 | N/A | N/A | 32705 | 32720 | GTAAGTAAAACTGCTG | 16 | 2369 |
| 1075378 | N/A | N/A | 35289 | 35304 | AAAACTAATCATCGAT | 83 | 2370 |
| 1075410 | N/A | N/A | 37572 | 37587 | GATTAACAGCCCTTTA | 36 | 2371 |
| 1075442 | N/A | N/A | 40105 | 40120 | TATTAGTTCTACGATT | 71 | 2372 |
| 1075474 | N/A | N/A | 41975 | 41990 | TTTAATAGGCTCTATC | 68 | 2373 |
| 1075506 | N/A | N/A | 44427 | 44442 | CATAAAGGTGACAGCC | 66 | 2374 |
| 1075538 | N/A | N/A | 46165 | 46180 | GAATTGGAACACCTCA | 66 | 2375 |
| 1075570 | N/A | N/A | 48306 | 48321 | GATACTAAGCACAGAG | 16 | 2376 |
| 1075602 | N/A | N/A | 50018 | 50033 | TATTATAAGTCTACAA | 114 | 2377 |
| 1075634 | N/A | N/A | 52121 | 52136 | AGACTATATTGGCTCC | 65 | 2378 |
| 1075666 | N/A | N/A | 53955 | 53970 | AAATTTAGTTGTGCAC | 106 | 2379 |
| 1075698 | N/A | N/A | 56114 | 56129 | GTTTAATAATCCATGC | 10 | 2380 |
| 1075730 | N/A | N/A | 58854 | 58869 | GTATTTAAAAATAGCG | 92 | 2381 |
| 1075762 | N/A | N/A | 61391 | 61406 | GATAAATGGGTTGATT | 20 | 2382 |
| 1075794 | N/A | N/A | 63266 | 63281 | CATAATGAATGTGGGT | 38 | 2383 |
| 1075826 | N/A | N/A | 66375 | 66390 | TAGGGAAAACCATAGC | 23 | 2384 |
| 1075858 | N/A | N/A | 68977 | 68992 | CCTTAAACAATCCCTA | 23 | 2385 |
| 1075890 | N/A | N/A | 72205 | 72220 | GATTAAAAGTAGGCCC | 92 | 2386 |
| 1075922 | N/A | N/A | 75778 | 75793 | GCCCAAAATAGGATAC | 60 | 2387 |
| 1075954 | N/A | N/A | 78881 | 78896 | ATTTAAGGCTGTGTTC | 50 | 2388 |
| 1075986 | N/A | N/A | 81253 | 81268 | GAATATCGAAAAGCAA | 26 | 2389 |
| 1076018 | N/A | N/A | 83004 | 83019 | ACTAATAGGATGGATT | 15 | 2390 |
| 1076050 | N/A | N/A | 85864 | 85879 | CTTTAGATTAAAGGCT | 45 | 2391 |
| 1076082 | N/A | N/A | 89791 | 89806 | TCTCAATACACTATAT | 38 | 2392 |
| 1076114 | N/A | N/A | 91589 | 91604 | ATTAGTAAGCTGAGGA | 3 | 2393 |
| 1076146 | N/A | N/A | 92471 | 92486 | GCTAAAACTTTCATCC | 23 | 2394 |
| 1076178 | N/A | N/A | 94474 | 94489 | CCTGAAATACAGGTGT | 100 | 2395 |
| 1076210 | N/A | N/A | 97442 | 97457 | ATTTATATGCTCCCTC | 20 | 2396 |
| 1076242 | N/A | N/A | 98645 | 98660 | ATGCAATAAGGAACAG | 33 | 2397 |
| 1076274 | N/A | N/A | 102073 | 102088 | TGAGAATAGAGCAGGT | 9 | 2398 |
| 1076306 | N/A | N/A | 104347 | 104362 | CTTTACTACTAATAAG | 99 | 2399 |
| 1076338 | N/A | N/A | 107327 | 107342 | CATTAAACCAGGGACT | 33 | 2400 |
| 1076370 | N/A | N/A | 110594 | 110609 | GATTATTCGGTATTTT | 2 | 2401 |
| 1076402 | N/A | N/A | 112324 | 112339 | CGTAATTATTTTGCT | 38 | 2402 |

TABLE 32-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076434 | N/A | N/A | 115047 | 115062 | CTTTAGGTTTATGCCT | 25 | 2403 |
| 1076466 | N/A | N/A | 118557 | 118572 | ATTTAGAGCTTAAGGA | 5 | 2404 |
| 1076498 | N/A | N/A | 120644 | 120659 | TTACAATACCTTATGA | 70 | 2405 |
| 1076530 | N/A | N/A | 64823 | 64838 | AGTATAAAGCAGGGCA | 5 | 2406 |
| 1076562 | N/A | N/A | 12922 | 12937 | TATTACAGAGGGTAGC | 17 | 2407 |

TABLE 33

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 4 | 810 |
| 1074131 | 222 | 237 | 3682 | 3697 | GGCCCCGCATCCCCCG | 72 | 2408 |
| 1074163 | 339 | 354 | 3799 | 3814 | CAGGCGAGCGAGGGCT | 118 | 2409 |
| 1074195 | 475 | 490 | 3935 | 3950 | CCCGGGTCCGGACGGC | 79 | 2410 |
| 1074227 | 860 | 875 | 7294 | 7309 | ACTGTCGAAGATGCTG | 10 | 2411 |
| 1074259 | 1046 | 1061 | 55541 | 55556 | TCATATTCTGCTGCAC | 38 | 2412 |
| 1074291 | 1202 | 1217 | 98904 | 98919 | CACTCTGACTGATTCT | 11 | 2413 |
| 1074323 | 1429 | 1444 | N/A | N/A | CAGGGCTAACTCCTGA | 116 | 2414 |
| 1074355 | 1615 | 1630 | 120520 | 120535 | AGGGACACTGTAGCTG | 55 | 2415 |
| 1074387 | 1734 | 1749 | 122759 | 122774 | CCAGGAATGGCTTCAA | 32 | 2416 |
| 1074419 | 2111 | 2126 | 123136 | 123151 | ATTCTTTAGAGCCAAC | 4 | 2417 |
| 1074451 | 2477 | 2492 | 123502 | 123517 | GACTAATGATAGCACT | 6 | 2418 |
| 1074483 | 2709 | 2724 | 123734 | 123749 | CACTAATATGGTCATT | 15 | 2419 |
| 1074515 | 2908 | 2923 | 123933 | 123948 | TAACTGGAAAGCAGGG | 9 | 2420 |
| 1074547 | 3068 | 3083 | 124093 | 124108 | GAGCACTCCCCTAGGC | 71 | 2421 |
| 1074579 | 3224 | 3239 | 124249 | 124264 | CCACTATAAAGCTTAT | 6 | 2422 |
| 1074611 | 3621 | 3636 | 124646 | 124661 | TAGCTTATATTGAAGA | 19 | 2423 |
| 1074643 | 3835 | 3850 | 124860 | 124875 | TTGAAGGGCCAAAATA | 68 | 2424 |
| 1074675 | 4161 | 4176 | 125186 | 125201 | AAATTATAGGCACTCC | 6 | 2425 |
| 1074707 | 4337 | 4352 | 125362 | 125377 | TTTAATGGCAGCACGG | 36 | 2426 |
| 1074739 | 4525 | 4540 | 125550 | 125565 | GACTCTTAGGTCTCCT | 24 | 2427 |
| 1074771 | 4644 | 4659 | 125669 | 125684 | AATCTTATCCCAATGC | 18 | 2428 |
| 1074803 | 4837 | 4852 | 125862 | 125877 | AGGCACTACATTTAGA | 32 | 2429 |
| 1074835 | 5102 | 5117 | 126127 | 126142 | CTTGCGAGGATAAAAT | 30 | 2430 |
| 1074867 | 5292 | 5307 | 126317 | 126332 | TAACATATGAGCATGC | 40 | 2431 |
| 1074899 | N/A | N/A | 5482 | 5497 | TAACTTTTGGGCAAAG | 52 | 2432 |
| 1074931 | N/A | N/A | 5601 | 5616 | GAGACTATACAACAGG | 35 | 2433 |
| 1074963 | N/A | N/A | 5710 | 5725 | TAGGCAAGCAGCTAAA | 76 | 2434 |
| 1074995 | N/A | N/A | 4785 | 4800 | AAAACTAAATGGACCG | 50 | 2435 |
| 1075027 | N/A | N/A | 6578 | 6593 | AAATTTGAACTGCCCA | 28 | 2436 |
| 1075059 | N/A | N/A | 8749 | 8764 | ATTTACTTTGGATGTC | 11 | 2437 |
| 1075091 | N/A | N/A | 10609 | 10624 | AAACAACGAATGATTG | 65 | 2438 |
| 1075123 | N/A | N/A | 12563 | 12578 | CTTTAGGAAAGGGTAT | 21 | 2439 |
| 1075155 | N/A | N/A | 16105 | 16120 | TCATTATAATGGGAGG | 5 | 2440 |
| 1075187 | N/A | N/A | 19108 | 19123 | GCCCAAGGAGGAAATC | 77 | 2441 |
| 1075219 | N/A | N/A | 23348 | 23363 | CCTTAACACTGGTAAG | 117 | 2442 |
| 1075251 | N/A | N/A | 27031 | 27046 | TAATTACGATTAGATC | 79 | 2443 |
| 1075283 | N/A | N/A | 29653 | 29668 | CGAATATAGAAAAATG | 90 | 2444 |
| 1075315 | N/A | N/A | 31772 | 31787 | CATAACTTGATGACTC | 27 | 2445 |
| 1075347 | N/A | N/A | 32821 | 32836 | CATAGGTAGGCAACAA | 20 | 2446 |
| 1075379 | N/A | N/A | 35306 | 35321 | TACCAAAACTACAACC | 75 | 2447 |
| 1075411 | N/A | N/A | 37768 | 37783 | CAAAAAGGGTAAGGCA | 39 | 2448 |
| 1075443 | N/A | N/A | 40138 | 40153 | GATTAACAGAGCTAGA | 29 | 2449 |
| 1075475 | N/A | N/A | 42037 | 42052 | TAGCAACACATGAAGA | 64 | 2450 |
| 1075507 | N/A | N/A | 44455 | 44470 | GTACAACCTAGTGATA | 82 | 2451 |
| 1075539 | N/A | N/A | 46198 | 46213 | CTTAAGGGATGGAACA | 79 | 2452 |
| 1075571 | N/A | N/A | 48312 | 48327 | CAAATAGATACTAAGC | 54 | 2453 |
| 1075603 | N/A | N/A | 50064 | 50079 | TATGAACAAGTATGAG | 35 | 2454 |
| 1075635 | N/A | N/A | 52207 | 52222 | AATAAACACCTCGCCA | 97 | 2455 |
| 1075667 | N/A | N/A | 53956 | 53971 | CAAATTTAGTTGTGCA | 109 | 2456 |
| 1075699 | N/A | N/A | 56158 | 56173 | GATTTATACTCAGGTT | 4 | 2457 |
| 1075731 | N/A | N/A | 58878 | 58893 | CCCCAATATTATCTAC | 40 | 2458 |
| 1075763 | N/A | N/A | 61435 | 61450 | ATTTAGGCTTTGGGTT | 16 | 2459 |
| 1075795 | N/A | N/A | 63289 | 63304 | GTAATTATATACCCAC | 66 | 2460 |
| 1075827 | N/A | N/A | 66457 | 66472 | ATACTATACCTAAGGA | 60 | 2461 |

TABLE 33-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075859 | N/A | N/A | 69260 | 69275 | ACTTATCACTCTGCCC | 20 | 2462 |
| 1075891 | N/A | N/A | 72206 | 72221 | AGATTAAAAGTAGGCC | 89 | 2463 |
| 1075923 | N/A | N/A | 75823 | 75838 | TTTAATACTCTCTGGG | 42 | 2464 |
| 1075955 | N/A | N/A | 79005 | 79020 | GACCTATAATACAGAA | 85 | 2465 |
| 1075987 | N/A | N/A | 81256 | 81271 | GAAGAATATCGAAAAG | 13 | 2466 |
| 1076019 | N/A | N/A | 83005 | 83020 | CACTAATAGGATGGAT | 12 | 2467 |
| 1076051 | N/A | N/A | 85945 | 85960 | CTTAACTATTCAGCCC | 21 | 2468 |
| 1076083 | N/A | N/A | 89966 | 89981 | CGCTATAAAGTGGCAT | 46 | 2469 |
| 1076115 | N/A | N/A | 91590 | 91605 | CATTAGTAAGCTGAGG | 7 | 2470 |
| 1076147 | N/A | N/A | 92516 | 92531 | ATTAACTCACGAAGAC | 25 | 2471 |
| 1076179 | N/A | N/A | 94487 | 94502 | AATTAGCCAACCACCT | 38 | 2472 |
| 1076211 | N/A | N/A | 97443 | 97458 | AATTTATATGCTCCCT | 22 | 2473 |
| 1076243 | N/A | N/A | 98790 | 98805 | ATATTCGATGTAACTT | 41 | 2474 |
| 1076275 | N/A | N/A | 102220 | 102235 | GTATTAGATAAAGCAG | 10 | 2475 |
| 1076307 | N/A | N/A | 104378 | 104393 | GTAATTACCTCTAATC | 38 | 2476 |
| 1076339 | N/A | N/A | 107352 | 107367 | CAGCAATACTGTGGGC | 13 | 2477 |
| 1076371 | N/A | N/A | 110712 | 110727 | TAAGAACGAACCTCCA | 49 | 2478 |
| 1076403 | N/A | N/A | 112457 | 112472 | ATTTAAGACCTGGTGA | 26 | 2479 |
| 1076435 | N/A | N/A | 115328 | 115343 | CGTAAACATCATCTCT | 12 | 2480 |
| 1076467 | N/A | N/A | 118559 | 118574 | GTATTTAGAGCTTAAG | 5 | 2481 |
| 1076499 | N/A | N/A | 121073 | 121088 | GCTAATATATCCAATT | 37 | 2482 |
| 1076531 | N/A | N/A | 66739 | 66754 | ACTATAAAGGGTTTAG | 66 | 2483 |
| 1076563 | N/A | N/A | 31631 | 31646 | CAAAGTAATTAAACGA | 91 | 2484 |

TABLE 34

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074132 | 223 | 238 | 3683 | 3698 | CGGCCCCGCATCCCCC | 96 | 2485 |
| 1074164 | 340 | 355 | 3800 | 3815 | CCAGGCGAGCGAGGGC | 135 | 2486 |
| 1074196 | 476 | 491 | 3936 | 3951 | GCCCGGGTCCGGACGG | 99 | 2487 |
| 1074228 | 861 | 876 | 7295 | 7310 | GACTGTCGAAGATGCT | 17 | 2488 |
| 1074260 | 1051 | 1066 | 55546 | 55561 | GTTCATCATATTCTGC | 48 | 2489 |
| 1074292 | 1216 | 1231 | 98918 | 98933 | CTGTTTCACTGGAGCA | 10 | 2490 |
| 1074324 | 1430 | 1445 | N/A | N/A | GCAGGGCTAACTCCTG | 116 | 2491 |
| 1074356 | 1616 | 1631 | 120521 | 120536 | GAGGGACACTGTAGCT | 43 | 2492 |
| 1074388 | 1805 | 1820 | 122830 | 122845 | GACTTGGCATCAGCTC | 16 | 2493 |
| 1074420 | 2112 | 2127 | 123137 | 123152 | GATTCTTTAGAGCCAA | 2 | 2494 |
| 1074452 | 2478 | 2493 | 123503 | 123518 | TGACTAATGATAGCAC | 3 | 2495 |
| 1074484 | 2710 | 2725 | 123735 | 123750 | TCACTAATATGGTCAT | 3 | 2496 |
| 1074516 | 2909 | 2924 | 123934 | 123949 | TTAACTGGAAAGCAGG | 22 | 2497 |
| 1074548 | 3093 | 3108 | 124118 | 124133 | ATCTACCGTATGCCCA | 4 | 2498 |
| 1074580 | 3225 | 3240 | 124250 | 124265 | ACCACTATAAAGCTTA | 5 | 2499 |
| 1074612 | 3622 | 3637 | 124647 | 124662 | ATAGCTTATATTGAAG | 12 | 2500 |
| 1074644 | 3836 | 3851 | 124861 | 124876 | ATTGAAGGGCCAAAAT | 93 | 2501 |
| 1074676 | 4162 | 4177 | 125187 | 125202 | CAAATTATAGGCACTC | 4 | 2502 |
| 1074708 | 4338 | 4353 | 125363 | 125378 | CTTTAATGGCAGCACG | 55 | 2503 |
| 1074740 | 4526 | 4541 | 125551 | 125566 | GGACTCTTAGGTCTCC | 75 | 2504 |
| 1074772 | 4650 | 4665 | 125675 | 125690 | AGTTAAAATCTTATCC | 80 | 2505 |
| 1074804 | 4874 | 4889 | 125899 | 125914 | TAGCAAAGTCACTTCC | 15 | 2506 |
| 1074836 | 5111 | 5126 | 126136 | 126151 | AACAACATGCTTGCGA | 27 | 2507 |
| 1074868 | 5297 | 5312 | 126322 | 126337 | GTACCTAACATATGAG | 74 | 2508 |
| 1074900 | N/A | N/A | 5484 | 5499 | ATTAACTTTTGGGCAA | 40 | 2509 |
| 1074932 | N/A | N/A | 5602 | 5617 | GGAGACTATACAACAG | 88 | 2510 |
| 1074964 | N/A | N/A | 5711 | 5726 | TTAGGCAAGCAGCTAA | 112 | 2511 |
| 1074996 | N/A | N/A | 4843 | 4858 | AATAAATGCTTACGGG | 60 | 2512 |
| 1075028 | N/A | N/A | 6670 | 6685 | AAAAATCAAGCCCTCG | 103 | 2513 |
| 1075060 | N/A | N/A | 8896 | 8911 | GTTTAACAATCTCCCC | 70 | 2514 |
| 1075092 | N/A | N/A | 10612 | 10627 | TTAAAACAACGAATGA | 63 | 2515 |
| 1075124 | N/A | N/A | 12652 | 12667 | GTAAAAACCTGGGTTT | 58 | 2516 |
| 1075156 | N/A | N/A | 16175 | 16190 | ATTATATGACTCTGCT | 22 | 2517 |
| 1075188 | N/A | N/A | 19193 | 19208 | AGTCAACCTGTAATTA | 14 | 2518 |
| 1075220 | N/A | N/A | 23362 | 23377 | AATTTTAACTGTGACC | 24 | 2519 |
| 1075252 | N/A | N/A | 27032 | 27047 | TTAATTACGATTAGAT | 90 | 2520 |

TABLE 34-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075284 | N/A | N/A | 29658 | 29673 | CTTTTCGAATATAGAA | 76 | 2521 |
| 1075316 | N/A | N/A | 31797 | 31812 | GTATATAGATACCCAC | 25 | 2522 |
| 1075348 | N/A | N/A | 32855 | 32870 | TCACAAAACCCTACAC | 96 | 2523 |
| 1075380 | N/A | N/A | 35609 | 35624 | ACTAAAACTGACTGTC | 94 | 2524 |
| 1075412 | N/A | N/A | 37770 | 37785 | TCCAAAAGGGTAAGG | 48 | 2525 |
| 1075444 | N/A | N/A | 40268 | 40283 | ATAAATCCTCATGTGG | 112 | 2526 |
| 1075476 | N/A | N/A | 42291 | 42306 | TCTTATCCTACAGCTT | 75 | 2527 |
| 1075508 | N/A | N/A | 44490 | 44505 | GAAAAAGGTTTAGGGT | 84 | 2528 |
| 1075540 | N/A | N/A | 46199 | 46214 | GCTTAAGGGATGGAAC | 78 | 2529 |
| 1075572 | N/A | N/A | 48372 | 48387 | CAATTTAACTGTTACA | 84 | 2530 |
| 1075604 | N/A | N/A | 50104 | 50119 | ATAATTAAGCTATCAC | 81 | 2531 |
| 1075636 | N/A | N/A | 52208 | 52223 | CAATAAACACCTCGCC | 91 | 2532 |
| 1075668 | N/A | N/A | 54032 | 54047 | AATTATTGGTGACACT | 80 | 2533 |
| 1075700 | N/A | N/A | 56179 | 56194 | GCCAAATAAGAGGTAG | 22 | 2534 |
| 1075732 | N/A | N/A | 58998 | 59013 | AATAACCTCGAGTGCT | 36 | 2535 |
| 1075764 | N/A | N/A | 61668 | 61683 | CTTCAAGGAAGGTGCT | 103 | 2536 |
| 1075796 | N/A | N/A | 63290 | 63305 | AGTAATTATATACCCA | 64 | 2537 |
| 1075828 | N/A | N/A | 66513 | 66528 | TTAGAATAGTTCTACC | 59 | 2538 |
| 1075860 | N/A | N/A | 69290 | 69305 | AACTATAAGCTATGTG | 73 | 2539 |
| 1075892 | N/A | N/A | 72236 | 72251 | CACCAATACCAAAGTC | 54 | 2540 |
| 1075924 | N/A | N/A | 75824 | 75839 | ATTTAATACTCTCTGG | 21 | 2541 |
| 1075956 | N/A | N/A | 79218 | 79233 | TATAAAGCAATGCGAT | 27 | 2542 |
| 1075988 | N/A | N/A | 81357 | 81372 | AATTAAGCTTCTCTAG | 90 | 2543 |
| 1076020 | N/A | N/A | 83011 | 83026 | CCCCAACACTAATAGG | 60 | 2544 |
| 1076052 | N/A | N/A | 86023 | 86038 | GCAATAAAGCTGAACT | 23 | 2545 |
| 1076084 | N/A | N/A | 89980 | 89995 | CATCAATAGAGAGTCG | 7 | 2546 |
| 1076116 | N/A | N/A | 91600 | 91615 | GAAAATAGCCCATTAG | 25 | 2547 |
| 1076148 | N/A | N/A | 92517 | 92532 | TATTAACTCACGAAGA | 52 | 2548 |
| 1076180 | N/A | N/A | 94489 | 94504 | ATAATTAGCCAACCAC | 42 | 2549 |
| 1076212 | N/A | N/A | 97445 | 97460 | CAAATTTATATGCTCC | 15 | 2550 |
| 1076244 | N/A | N/A | 98799 | 98814 | CAATTTGGGATATTCG | 14 | 2551 |
| 1076276 | N/A | N/A | 102282 | 102297 | CTTTAGGAGTCAGAAC | 59 | 2552 |
| 1076308 | N/A | N/A | 104379 | 104394 | AGTAATTACCTCTAAT | 32 | 2553 |
| 1076340 | N/A | N/A | 107364 | 107379 | TAATATCCTCATCAGC | 8 | 2554 |
| 1076372 | N/A | N/A | 110715 | 110730 | CAATAAGAACGAACCT | 76 | 2555 |
| 1076404 | N/A | N/A | 112458 | 112473 | TATTTAAGACCTGGTG | 13 | 2556 |
| 1076436 | N/A | N/A | 115413 | 115428 | CATTACTACTCTGTCC | 39 | 2557 |
| 1076468 | N/A | N/A | 118602 | 118617 | CATTACTACTAAGAGT | 91 | 2558 |
| 1076500 | N/A | N/A | 121129 | 121144 | CAATTAAGATCAACAT | 99 | 2559 |
| 1076532 | N/A | N/A | 68936 | 68951 | ATTTTTAGGCAGACGC | 12 | 2560 |
| 1076564 | N/A | N/A | 39617 | 39632 | TAAAGTAATGCTACAG | 77 | 2561 |

TABLE 35

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074133 | 224 | 239 | 3684 | 3699 | GCGGCCCCGCATCCCC | 101 | 2562 |
| 1074165 | 341 | 356 | 3801 | 3816 | CCCAGGCGAGCGAGGG | 90 | 2563 |
| 1074197 | 477 | 492 | 3937 | 3952 | TGCCCGGGTCCGGACG | 91 | 2564 |
| 1074229 | 864 | 879 | 7298 | 7313 | GAAGACTGTCGAAGAT | 5 | 2565 |
| 1074261 | 1055 | 1070 | 55550 | 55565 | CCGAGTTCATCATATT | 19 | 2566 |
| 1074293 | 1217 | 1232 | 98919 | 98934 | GCTGTTTCACTGGAGC | 54 | 2567 |
| 1074325 | 1431 | 1446 | 116620 | 116635 | CGCAGGGCTAACTCCT | 42 | 2568 |
| 1074357 | 1617 | 1632 | 120522 | 120537 | CGAGGGACACTGTAGC | 12 | 2569 |
| 1074389 | 1808 | 1823 | 122833 | 122848 | GCAGACTTGGCATCAG | 14 | 2570 |
| 1074421 | 2113 | 2128 | 123138 | 123153 | TGATTCTTTAGAGCCA | 3 | 2571 |
| 1074453 | 2479 | 2494 | 123504 | 123519 | GTGACTAATGATAGCA | 4 | 2572 |
| 1074485 | 2711 | 2726 | 123736 | 123751 | TTCACTAATATGGTCA | 4 | 2573 |
| 1074517 | 2939 | 2954 | 123964 | 123979 | AATGCATACAAAGCGC | 55 | 2574 |
| 1074549 | 3094 | 3109 | 124119 | 124134 | TATCTACCGTATGCCC | 6 | 2575 |

TABLE 35-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1074581 | 3226 | 3241 | 124251 | 124266 | AACCACTATAAAGCTT | 18 | 2576 |
| 1074613 | 3623 | 3638 | 124648 | 124663 | CATAGCTTATATTGAA | 7 | 2577 |
| 1074645 | 3837 | 3852 | 124862 | 124877 | AATTGAAGGGCCAAAA | 81 | 2578 |
| 1074677 | 4169 | 4184 | 125194 | 125209 | CTACTGGCAAATTATA | 22 | 2579 |
| 1074709 | 4352 | 4367 | 125377 | 125392 | TCTAGAACAGCTGCCT | 71 | 2580 |
| 1074741 | 4528 | 4543 | 125553 | 125568 | AAGGACTCTTAGGTCT | 78 | 2581 |
| 1074773 | 4651 | 4666 | 125676 | 125691 | CAGTTAAAATCTTATC | 94 | 2582 |
| 1074805 | 4875 | 4890 | 125900 | 125915 | GTAGCAAAGTCACTTC | 9 | 2583 |
| 1074837 | 5112 | 5127 | 126137 | 126152 | TAACAACATGCTTGCG | 11 | 2584 |
| 1074869 | 5298 | 5313 | 126323 | 126338 | AGTACCTAACATATGA | 31 | 2585 |
| 1074901 | N/A | N/A | 5485 | 5500 | TATTAACTTTTGGGCA | 61 | 2586 |
| 1074933 | N/A | N/A | 5603 | 5618 | AGGAGACTATACAACA | 72 | 2587 |
| 1074965 | N/A | N/A | 5715 | 5730 | GTGTTTAGGCAAGCAG | 20 | 2588 |
| 1074997 | N/A | N/A | 4854 | 4869 | GCCGCGAGGAAAATAA | 119 | 2589 |
| 1075029 | N/A | N/A | 7004 | 7019 | ATATTCGACACTGGAG | 33 | 2590 |
| 1075061 | N/A | N/A | 8954 | 8969 | CCTTATACTTTTAGCC | 5 | 2591 |
| 1075093 | N/A | N/A | 10664 | 10679 | CAAAGTAAGGTATGAG | 3 | 2592 |
| 1075125 | N/A | N/A | 12777 | 12792 | CTTAAGGTACAAGGCA | 84 | 2593 |
| 1075157 | N/A | N/A | 16192 | 16207 | CCAGAAAATCATAGTA | 19 | 2594 |
| 1075189 | N/A | N/A | 19238 | 19253 | GCTAATAGTCACTGTT | 11 | 2595 |
| 1075221 | N/A | N/A | 23384 | 23399 | CATTATCCGGGAGAGC | 10 | 2596 |
| 1075253 | N/A | N/A | 27033 | 27048 | GTTAATTACGATTAGA | 20 | 2597 |
| 1075285 | N/A | N/A | 29702 | 29717 | TATACATAGTCAATTC | 60 | 2598 |
| 1075317 | N/A | N/A | 31832 | 31847 | GTATTCGCCTCCTGCA | 27 | 2599 |
| 1075349 | N/A | N/A | 33000 | 33015 | ATTAAAGCTCATTGAT | 81 | 2600 |
| 1075381 | N/A | N/A | 35767 | 35782 | TATTACCCTACTCATA | 89 | 2601 |
| 1075413 | N/A | N/A | 37807 | 37822 | CATAACTACATCGACA | 34 | 2602 |
| 1075445 | N/A | N/A | 40269 | 40284 | TATAAATCCTCATGTG | 84 | 2603 |
| 1075477 | N/A | N/A | 42405 | 42420 | CTTTATCTCACTAGCT | 86 | 2604 |
| 1075509 | N/A | N/A | 44622 | 44637 | CATAATCCCTGACTTG | 81 | 2605 |
| 1075541 | N/A | N/A | 46250 | 46265 | GCTCAAAACTGACATA | 47 | 2606 |
| 1075573 | N/A | N/A | 48504 | 48519 | AAGGAACCTTCTGTGT | 72 | 2607 |
| 1075605 | N/A | N/A | 50176 | 50191 | CGTAAACATTTTGCCT | 38 | 2608 |
| 1075637 | N/A | N/A | 52219 | 52234 | CCACAACCTGTCAATA | 100 | 2609 |
| 1075669 | N/A | N/A | 54033 | 54048 | AAATTATTGGTGACAC | 70 | 2610 |
| 1075701 | N/A | N/A | 56296 | 56311 | AATTACTAGAGGCTTC | 3 | 2611 |
| 1075733 | N/A | N/A | 58999 | 59014 | CAATAACCTCGAGTGC | 28 | 2612 |
| 1075765 | N/A | N/A | 61721 | 61736 | CTTAAGGCAGCTCTAT | 58 | 2613 |
| 1075797 | N/A | N/A | 63378 | 63393 | GATAATCATGATACTC | 3 | 2614 |
| 1075829 | N/A | N/A | 66603 | 66618 | ACTCAATAGATCATTG | 41 | 2615 |
| 1075861 | N/A | N/A | 69291 | 69306 | TAACTATAAGCTATGT | 78 | 2616 |
| 1075893 | N/A | N/A | 72284 | 72299 | CGTGAAAAAGATGTGG | 7 | 2617 |
| 1075925 | N/A | N/A | 75907 | 75922 | AACCTATATTATTTGC | 28 | 2618 |
| 1075957 | N/A | N/A | 79219 | 79234 | CTATAAAGCAATGCGA | 28 | 2619 |
| 1075989 | N/A | N/A | 81362 | 81377 | GCTAAAATTAAGCTTC | 78 | 2620 |
| 1076021 | N/A | N/A | 83058 | 83073 | CATTAATAAAGTTACC | 95 | 2621 |
| 1076053 | N/A | N/A | 86047 | 86062 | TACCAACAAGGCATCA | 55 | 2622 |
| 1076085 | N/A | N/A | 90079 | 90094 | ACTAATAGGCCATCTG | 7 | 2623 |
| 1076117 | N/A | N/A | 91603 | 91618 | CTAGAAAATAGCCCAT | 15 | 2624 |
| 1076149 | N/A | N/A | 92518 | 92533 | TTATTAACTCACGAAG | 24 | 2625 |
| 1076181 | N/A | N/A | 94490 | 94505 | TATAATTAGCCAACCA | 26 | 2626 |
| 1076213 | N/A | N/A | 97518 | 97533 | TCTCAAGGAATTGCCT | 27 | 2627 |
| 1076245 | N/A | N/A | 98849 | 98864 | CCTAAAAAACTAGTGA | 101 | 2628 |
| 1076277 | N/A | N/A | 102574 | 102589 | GCTAAAACATCAGATA | 24 | 2629 |
| 1076309 | N/A | N/A | 104525 | 104540 | GATAACTTTCCACAAT | 9 | 2630 |
| 1076341 | N/A | N/A | 107422 | 107437 | ATTAACTACAACTGTG | 18 | 2631 |
| 1076373 | N/A | N/A | 111082 | 111097 | AACGGATATACAATAA | 10 | 2632 |
| 1076405 | N/A | N/A | 112459 | 112474 | TTATTTAAGACCTGGT | 12 | 2633 |
| 1076437 | N/A | N/A | 115843 | 115858 | GAAGAATAGCATCTGA | 19 | 2634 |
| 1076469 | N/A | N/A | 118627 | 118642 | GTAAAAGGGAACTAAG | 69 | 2635 |
| 1076501 | N/A | N/A | 121268 | 121283 | CATAACACTTAAGGTG | 97 | 2636 |
| 1076533 | N/A | N/A | 75580 | 75595 | ATTTTTAGTCCAGTGG | 9 | 2637 |
| 1076565 | N/A | N/A | 55334 | 55349 | CATTAAGTCACAGCAT | 74 | 2638 |

TABLE 36

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 1 | 810 |
| 1074134 | 225 | 240 | 3685 | 3700 | CGCGGCCCCGCATCCC | 79 | 2639 |
| 1074166 | 342 | 357 | 3802 | 3817 | ACCCAGGCGAGCGAGG | 72 | 2640 |
| 1074198 | 478 | 493 | 3938 | 3953 | TTGCCCGGGTCCGGAC | 112 | 2641 |
| 1074230 | 866 | 881 | 7300 | 7315 | AAGAAGACTGTCGAAG | 4 | 2642 |
| 1074262 | 1056 | 1071 | 55551 | 55566 | GCCGAGTTCATCATAT | 48 | 2643 |
| 1074294 | 1275 | 1290 | 98977 | 98992 | TTGGAGTTGCTGCCAC | 80 | 2644 |
| 1074326 | 1432 | 1447 | 116621 | 116636 | ACGCAGGGCTAACTCC | 36 | 2645 |
| 1074358 | 1618 | 1633 | 120523 | 120538 | TCGAGGGACACTGTAG | 17 | 2646 |
| 1074390 | 1810 | 1825 | 122835 | 122850 | CTGCAGACTTGGCATC | 64 | 2647 |
| 1074422 | 2189 | 2204 | 123214 | 123229 | AAACAGGCTCACTTCC | 9* | 2648 |
| 1074454 | 2480 | 2495 | 123505 | 123520 | TGTGACTAATGATAGC | 1 | 2649 |
| 1074486 | 2712 | 2727 | 123737 | 123752 | ATTCACTAATATGGTC | 4 | 2650 |
| 1074518 | 2940 | 2955 | 123965 | 123980 | AAATGCATACAAAGCG | 13 | 2651 |
| 1074550 | 3095 | 3110 | 124120 | 124135 | ATATCTACCGTATGCC | 23 | 2652 |
| 1074582 | 3228 | 3243 | 124253 | 124268 | TAAACCACTATAAAGC | 18 | 2653 |
| 1074614 | 3624 | 3639 | 124649 | 124664 | TCATAGCTTATATTGA | 49 | 2654 |
| 1074646 | 3838 | 3853 | 124863 | 124878 | AAATTGAAGGGCCAAA | 39 | 2655 |
| 1074678 | 4179 | 4194 | 125204 | 125219 | TAATCTGTGGCTACTG | 7 | 2656 |
| 1074710 | 4353 | 4368 | 125378 | 125393 | CTCTAGAACAGCTGCC | 42 | 2657 |
| 1074742 | 4529 | 4544 | 125554 | 125569 | AAAGGACTCTTAGGTC | 25 | 2658 |
| 1074774 | 4661 | 4676 | 125686 | 125701 | CAAGAATACCCAGTTA | 16 | 2659 |
| 1074806 | 4877 | 4892 | 125902 | 125917 | TTGTAGCAAAGTCACT | 8 | 2660 |
| 1074838 | 5113 | 5128 | 126138 | 126153 | ATAACAACATGCTTGC | 9 | 2661 |
| 1074870 | 5301 | 5316 | 126326 | 126341 | GTAAGTACCTAACATA | 20 | 2662 |
| 1074902 | N/A | N/A | 5486 | 5501 | CTATTAACTTTTGGGC | 54 | 2663 |
| 1074934 | N/A | N/A | 5604 | 5619 | CAGGAGACTATACAAC | 74 | 2664 |
| 1074966 | N/A | N/A | 5721 | 5736 | ATTGAAGTGTTTAGGC | 9 | 2665 |
| 1074998 | N/A | N/A | 4998 | 5013 | CACGCGACCTACTAAG | 61 | 2666 |
| 1075030 | N/A | N/A | 7007 | 7022 | TTAATATTCGACACTG | 37 | 2667 |
| 1075062 | N/A | N/A | 8960 | 8975 | CTTTAACCTTATACTT | 58 | 2668 |
| 1075094 | N/A | N/A | 10705 | 10720 | GATAAATGTAACTAGC | 10 | 2669 |
| 1075126 | N/A | N/A | 12890 | 12905 | CTTAAATCTTAGCAAC | 20 | 2670 |
| 1075158 | N/A | N/A | 16240 | 16255 | CGGCAAAAACAAAATC | 76 | 2671 |
| 1075190 | N/A | N/A | 19295 | 19310 | TATCAAGGATTCAGTA | 45 | 2672 |
| 1075222 | N/A | N/A | 23766 | 23781 | GTATTTGGACAACTCT | 3 | 2673 |
| 1075254 | N/A | N/A | 27099 | 27114 | TCCCAAAAGTCATCGC | 28 | 2674 |
| 1075286 | N/A | N/A | 29807 | 29822 | ATTACGGACAGAAGTG | 48 | 2675 |
| 1075318 | N/A | N/A | 31850 | 31865 | ATCCTAAAGCCACTGC | 72 | 2676 |
| 1075350 | N/A | N/A | 33001 | 33016 | GATTAAAGCTCATTGA | 62 | 2677 |
| 1075382 | N/A | N/A | 35769 | 35784 | ATTATTACCCTACTCA | 33 | 2678 |
| 1075414 | N/A | N/A | 37990 | 38005 | CATACTAATCCCTCTT | 41 | 2679 |
| 1075446 | N/A | N/A | 40270 | 40285 | CTATAAATCCTCATGT | 87 | 2680 |
| 1075478 | N/A | N/A | 42416 | 42431 | CATTTTGAACCCTTTA | 20 | 2681 |
| 1075510 | N/A | N/A | 44630 | 44645 | GAATAACACATAATCC | 83 | 2682 |
| 1075542 | N/A | N/A | 46607 | 46622 | TGAGAAAGGTTCCTGA | 66 | 2683 |
| 1075574 | N/A | N/A | 48508 | 48523 | AGTCAAGGAACCTTCT | 47 | 2684 |
| 1075606 | N/A | N/A | 50368 | 50383 | GCTAAACCTACACGCT | 82 | 2685 |
| 1075638 | N/A | N/A | 52324 | 52339 | ATTACCAGAAGCCTG | 79 | 2686 |
| 1075670 | N/A | N/A | 54501 | 54516 | TATATATGATGGACTG | 39 | 2687 |
| 1075702 | N/A | N/A | 56442 | 56457 | GAGGAAGGGCACCTTT | 81 | 2688 |
| 1075734 | N/A | N/A | 59002 | 59017 | AGGCAATAACCTCGAG | 26 | 2689 |
| 1075766 | N/A | N/A | 61741 | 61756 | GGAGAACACAAGAGGC | 5 | 2690 |
| 1075798 | N/A | N/A | 63396 | 63411 | ATTTAGATAGTTACTG | 21 | 2691 |
| 1075830 | N/A | N/A | 66610 | 66625 | GATGAACACTCAATAG | 12 | 2692 |
| 1075862 | N/A | N/A | 70001 | 70016 | CTAATAACTTGTCTAC | 67 | 2693 |
| 1075894 | N/A | N/A | 72305 | 72320 | CTCGAAAGCTGGGCCC | 100 | 2694 |
| 1075926 | N/A | N/A | 75911 | 75926 | GTAGAACCTATATTAT | 25 | 2695 |
| 1075958 | N/A | N/A | 79351 | 79366 | CATTATGACATTCCCC | 12 | 2696 |
| 1075990 | N/A | N/A | 81490 | 81505 | CGTTATTATGCAGCAA | 1 | 2697 |
| 1076022 | N/A | N/A | 83093 | 83108 | TAATTAGATGCTGACA | 2 | 2698 |
| 1076054 | N/A | N/A | 86104 | 86119 | CATTAGACTTTCTGTC | 21 | 2699 |
| 1076086 | N/A | N/A | 90080 | 90095 | AACTAATAGGCCATCT | 31 | 2700 |
| 1076118 | N/A | N/A | 91688 | 91703 | CGTAAATTGAGGCCCA | 45 | 2701 |
| 1076150 | N/A | N/A | 92520 | 92535 | ATTTATTAACTCACGA | 11 | 2702 |
| 1076182 | N/A | N/A | 94491 | 94506 | CTATAATTAGCCAACC | 15 | 2703 |
| 1076214 | N/A | N/A | 97543 | 97558 | ATCCTATACATTAAGA | 67 | 2704 |
| 1076246 | N/A | N/A | 98850 | 98865 | TCCTAAAAACTAGTG | 75 | 2705 |
| 1076278 | N/A | N/A | 102644 | 102659 | AATAAGGACAGGACCC | 29 | 2706 |
| 1076310 | N/A | N/A | 104554 | 104569 | ACCCTATACTTGAATT | 36 | 2707 |
| 1076342 | N/A | N/A | 107423 | 107438 | CATTAACTACAACTGT | 33 | 2708 |
| 1076374 | N/A | N/A | 111084 | 111099 | ATAACGGATATACAAT | 15 | 2709 |
| 1076406 | N/A | N/A | 112460 | 112475 | ATTATTAAGACCTGG | 4 | 2710 |

TABLE 36-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1076438 | N/A | N/A | 115846 | 115861 | TAGGAAGAATAGCATC | 13 | 2711 |
| 1076470 | N/A | N/A | 118843 | 118858 | GATAAAGAGGTTAACA | 34 | 2712 |
| 1076502 | N/A | N/A | 121320 | 121335 | CAAAGTAAGTGAGCCC | 17 | 2713 |
| 1076534 | N/A | N/A | 79220 | 79235 | ACTATAAAGCAATGCG | 4 | 2714 |
| 1076566 | N/A | N/A | 55576 | 55591 | AATTACAGTGTCTCAC | 63 | 2715 |

TABLE 37

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 958499 | 2565 | 2580 | 123590 | 123605 | ATTAGAGTATGTGGCA | 2 | 810 |
| 1074135 | 226 | 241 | 3686 | 3701 | CCGCGGCCCCGCATCC | 91 | 2716 |
| 1074167 | 353 | 368 | 3813 | 3828 | CGCACCCCCTGACCCA | 58 | 2717 |
| 1074199 | 483 | 498 | 3943 | 3958 | GCCGGTTGCCCGGGTC | 101 | 2718 |
| 1074231 | 867 | 882 | 7301 | 7316 | AAAGAAGACTGTCGAA | 8 | 2719 |
| 1074263 | 1057 | 1072 | 55552 | 55567 | AGCCGAGTTCATCATA | 34 | 2720 |
| 1074295 | 1278 | 1293 | 98980 | 98995 | TGGTTGGAGTTGCTGC | 15 | 2721 |
| 1074327 | 1433 | 1448 | 116622 | 116637 | TACGCAGGGCTAACTC | 39 | 2722 |
| 1074359 | 1619 | 1634 | 120524 | 120539 | TTCGAGGGACACTGTA | 18 | 2723 |
| 1074391 | 1828 | 1843 | 122853 | 122868 | GTCAGAACTCAAAGCT | 14 | 2724 |
| 1074423 | 2190 | 2205 | 123215 | 123230 | CAAACAGGCTCACTTC | 4* | 2725 |
| 1074455 | 2485 | 2500 | 123510 | 123525 | CATTATGTGACTAATG | 67 | 2726 |
| 1074487 | 2714 | 2729 | 123739 | 123754 | AGATTCACTAATATGG | 7 | 2727 |
| 1074519 | 2959 | 2974 | 123984 | 123999 | ACTACTAGTCATGTAT | 45 | 2728 |
| 1074551 | 3096 | 3111 | 124121 | 124136 | AATATCTACCGTATGC | 58 | 2729 |
| 1074583 | 3229 | 3244 | 124254 | 124269 | GTAAACCACTATAAAG | 30 | 2730 |
| 1074615 | 3625 | 3640 | 124650 | 124665 | TTCATAGCTTATATTG | 8 | 2731 |
| 1074647 | 3839 | 3854 | 124864 | 124879 | CAAATTGAAGGGCCAA | 27 | 2732 |
| 1074679 | 4182 | 4197 | 125207 | 125222 | TCTTAATCTGTGGCTA | 5 | 2733 |
| 1074711 | 4354 | 4369 | 125379 | 125394 | ACTCTAGAACAGCTGC | 28 | 2734 |
| 1074743 | 4530 | 4545 | 125555 | 125570 | GAAAGGACTCTTAGGT | 16 | 2735 |
| 1074775 | 4681 | 4696 | 125706 | 125721 | GGTTTATTGTAAAAGC | 3 | 2736 |
| 1074807 | 4927 | 4942 | 125952 | 125967 | CCATATAGAAGGCATG | 75 | 2737 |
| 1074839 | 5114 | 5129 | 126139 | 126154 | TATAACAACATGCTTG | 33 | 2738 |
| 1074871 | 5302 | 5317 | 126327 | 126342 | TGTAAGTACCTAACAT | 70 | 2739 |
| 1074903 | N/A | N/A | 5487 | 5502 | CCTATTAACTTTTGGG | 87 | 2740 |
| 1074935 | N/A | N/A | 5605 | 5620 | ACAGGAGACTATACAA | 80 | 2741 |
| 1074967 | N/A | N/A | 5726 | 5741 | GACAAATTGAAGTGTT | 116 | 2742 |
| 1074999 | N/A | N/A | 5004 | 5019 | AACCAACACGCGACCT | 77 | 2743 |
| 1075031 | N/A | N/A | 7009 | 7024 | ATTTAATATTCGACAC | 52 | 2744 |
| 1075063 | N/A | N/A | 9104 | 9119 | TACGGAAGGCCAACTG | 16 | 2745 |
| 1075095 | N/A | N/A | 10722 | 10737 | CTTGAAAACAAGCCAC | 63 | 2746 |
| 1075127 | N/A | N/A | 12934 | 12949 | GCTAAATTATGCTATT | 79 | 2747 |
| 1075159 | N/A | N/A | 16250 | 16265 | CAAAAAATCACGGCAA | 63 | 2748 |
| 1075191 | N/A | N/A | 19412 | 19427 | ACGGGAAAGAAAGGCC | 83 | 2749 |
| 1075223 | N/A | N/A | 23854 | 23869 | GTTAAAAGTGAACCCA | 19 | 2750 |
| 1075255 | N/A | N/A | 27113 | 27128 | AAATATCCGTGTCCTC | 16 | 2751 |
| 1075287 | N/A | N/A | 29808 | 29823 | TATTACGGACAGAAGT | 58 | 2752 |
| 1075319 | N/A | N/A | 31860 | 31875 | TATAACAATCATCCTA | 59 | 2753 |
| 1075351 | N/A | N/A | 33002 | 33017 | AGATTAAAGCTCATTG | 38 | 2754 |
| 1075383 | N/A | N/A | 35770 | 35785 | AATTATTACCCTACTC | 45 | 2755 |
| 1075415 | N/A | N/A | 38069 | 38084 | CATTAAATGACAGCCT | 52 | 2756 |
| 1075447 | N/A | N/A | 40272 | 40287 | CACTATAAATCCTCAT | 96 | 2757 |
| 1075479 | N/A | N/A | 42463 | 42478 | GACAATAAATCTGCCT | 77 | 2758 |
| 1075511 | N/A | N/A | 44708 | 44723 | CAATATTATCTGAGCT | 106 | 2759 |
| 1075543 | N/A | N/A | 46674 | 46689 | ATATATTAGGAGTTTC | 22 | 2760 |
| 1075575 | N/A | N/A | 48710 | 48725 | TTACAACACAAGTCTA | 55 | 2761 |
| 1075607 | N/A | N/A | 50539 | 50554 | AAAACGGTGTGAAGAA | 45 | 2762 |
| 1075639 | N/A | N/A | 52325 | 52340 | AATTAACCAGAAGCCT | 101 | 2763 |
| 1075671 | N/A | N/A | 54503 | 54518 | GATATATATGATGGAC | 37 | 2764 |

TABLE 37-continued

Inhibition of Yap1 mRNA by 3-10-3 cEt gapmers targeting SEQ ID NO.: 1, and 2

| Compund Number | SEQ ID NO: 1 Start Site | SEQ ID NO: 1 Stop Site | SEQ ID NO: 2 Start Site | SEQ ID NO: 2 Stop Site | Sequence (5' to 3') | YAP1 (% UTC) | SEQ ID NO |
|---|---|---|---|---|---|---|---|
| 1075703 | N/A | N/A | 56609 | 56624 | GGAGAAAGCCATCAAG | 10 | 2765 |
| 1075735 | N/A | N/A | 59100 | 59115 | GAATCGATGTGTTGCG | 17 | 2766 |
| 1075767 | N/A | N/A | 61758 | 61773 | TATTACACAGGCAGGC | 12 | 2767 |
| 1075799 | N/A | N/A | 63412 | 63427 | CCTCAACACATTTGAG | 85 | 2768 |
| 1075831 | N/A | N/A | 66680 | 66695 | TATTAGCCTTCTAACC | 59 | 2769 |
| 1075863 | N/A | N/A | 70002 | 70017 | CCTAATAACTTGTCTA | 71 | 2770 |
| 1075895 | N/A | N/A | 72306 | 72321 | ACTCGAAAGCTGGGCC | 38 | 2771 |
| 1075927 | N/A | N/A | 75923 | 75938 | GCTTAAAATCATGTAG | 32 | 2772 |
| 1075959 | N/A | N/A | 79446 | 79461 | GATTATTATTGCAGCT | 15 | 2773 |
| 1075991 | N/A | N/A | 81533 | 81548 | ATATAGGACCACGACT | 62 | 2774 |
| 1076023 | N/A | N/A | 83094 | 83109 | ATAATTAGATGCTGAC | 4 | 2775 |
| 1076055 | N/A | N/A | 86186 | 86201 | AATTACTAACAATCTC | 45 | 2776 |
| 1076087 | N/A | N/A | 90082 | 90097 | CAAACTAATAGGCCAT | 10 | 2777 |
| 1076119 | N/A | N/A | 91742 | 91757 | GTTAAATATGAATTGG | 7 | 2778 |
| 1076151 | N/A | N/A | 92521 | 92536 | TATTTATTAACTCACG | 14 | 2779 |
| 1076183 | N/A | N/A | 94494 | 94509 | CTTCTATAATTAGCCA | 7 | 2780 |
| 1076215 | N/A | N/A | 97620 | 97635 | TTATAACAGACTGGCT | 47 | 2781 |
| 1076247 | N/A | N/A | 99297 | 99312 | GACCAAAACAGCTCTT | 11 | 2782 |
| 1076279 | N/A | N/A | 102645 | 102660 | CAATAAGGACAGGACC | 71 | 2783 |
| 1076311 | N/A | N/A | 104558 | 104573 | TATAACCCTATACTTG | 56 | 2784 |
| 1076343 | N/A | N/A | 107707 | 107722 | AGACTAAATCTTCCCT | 8 | 2785 |
| 1076375 | N/A | N/A | 111085 | 111100 | TATAACGGATATACAA | 22 | 2786 |
| 1076407 | N/A | N/A | 112462 | 112477 | GTATTATTTAAGACCT | 22 | 2787 |
| 1076439 | N/A | N/A | 115906 | 115921 | CTTATATGGTTTTGTG | 4 | 2788 |
| 1076471 | N/A | N/A | 118862 | 118877 | CATTAGACTAGGCTTT | 5 | 2789 |
| 1076503 | N/A | N/A | 121702 | 121717 | AATTACCCCTGTGAGG | 77 | 2790 |
| 1076535 | N/A | N/A | 83322 | 83337 | ATTTTTAGCTCGCAAT | 28 | 2791 |
| 1076567 | N/A | N/A | 59365 | 59380 | GATTACAGTGACATTC | 10 | 2792 |

TABLE 32

Inhibition of Yap1 mRNA by 3-10-3 cEt gapmers targeting SEQ ID NO.: 3

| Compund Number | SEQ ID NO: 3 Start Site | SEQ ID NO: 3 Stop Site | Sequence (5' to 3') | YAP1 % UTC | SEQ ID NO |
|---|---|---|---|---|---|
| 1074880 | 1246 | 1261 | CTCCTGCCGAAGCAGT | 101 | 2793 |
| 1074881 | 1250 | 1265 | CTAACTCCTGCCGAAG | 76 | 2794 |
| 1074882 | 1251 | 1266 | GCTAACTCCTGCCGAA | 73 | 2795 |
| 1074883 | 1252 | 1267 | GGCTAACTCCTGCCGA | 107 | 2796 |
| 1074884 | 1253 | 1268 | GGGCTAACTCCTGCCG | 110 | 2797 |
| 1074885 | 1254 | 1269 | AGGGCTAACTCCTGCC | 115 | 2798 |
| 1074886 | 1255 | 1270 | CAGGGCTAACTCCTGC | 104 | 2799 |

Example 5

Antisense Inhibition of Human Yap1 in SNU-449 Cells by Modified Oligonucleotides Modified oligonucleotides with additional chemistry modifications were designed to target a Yap1 nucleic acid and were tested for their effect on Yap1 mRNA level in SNU-449 cells. The modified oligonucleotides were tested in a series of experiments that had similar culture conditions. The results for each experiment are presented in separate tables shown below. Cultured SNU-449 cells at a density of 10,000 cells per well were treated using free uptake with 2,000 nM of modified oligonucleotide. After a treatment period of approximately 48 hours, RNA was isolated from the cells and Yap1 mRNA levels were measured by quantitative real-time RTPCR. Human primer probe set RTS36584 was used to measure mRNA levels. Yap1 mRNA levels were normalized to total RNA content, as measured by RIBOGREEN®. Results are presented in the tables below as percent control of the amount of Yap1 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

Several different chemistry modifications were tested, which are specified in the Chemistry Notation column of the tables below, wherein the notation "d" refers to a 2'-deoxyribose sugar, the notation "s" refers to a phosphorothioate (P=S) internucleoside linkage, the notation "k" refers to a cEt modified sugar, the notation "y" refers to a 2'-O-methyl ribose sugar, the notation "e" refers to a MOE modified sugar, and the notation "$^{m}$C" refers to a 5-methylcytosine.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1 or SEQ ID NO.: 2. 'N/A' indicates that the modified oligonucleotide does not target that particular gene sequence with 100% complementarity. 'N.D.' indicates that the % UTC is not defined for that particular modified oligonucleotide in that particular experiment. Activity of the modified oligonucleotide may be defined in a different experiment.

TABLE 39

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 12 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 8 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 7 | 2800 |
| 1095379 | 4443 | 4458 | 125468 | 125483 | ACTGAGGTATAACTGG | $A_{ks}{}^mC_{ds}T_{ds}G_{ds}A_{ds}G_{ds}G_{ds}T_{ds}A_{ds}T_{ds}A_{ds}A_{ds}{}^mC_{es}T_{ks}G_{es}G_k$ | 52 | 392 |
| 1095397 | 4441 | 4456 | 125466 | 125481 | TGAGGTATAACTGGGC | $T_{ks}G_{ds}A_{ds}G_{ds}G_{ds}T_{ds}A_{ds}T_{ds}A_{ds}A_{ds}{}^mC_{ds}T_{ks}G_{es}G_{ks}G_{es}{}^mC_k$ | 53 | 1580 |
| 1095398 | 4442 | 4457 | 125467 | 125482 | CTGAGGTATAACTGGG | ${}^mC_{ks}T_{ds}G_{ds}A_{ds}G_{ds}G_{ds}T_{ds}A_{ds}T_{ds}A_{ds}A_{ds}{}^mC_{ks}T_{es}G_{ks}G_{es}G_k$ | 38 | 2801 |
| 1095399 | 4444 | 4459 | 125469 | 125484 | CACTGAGGTATAACTG | ${}^mC_{ks}A_{ds}{}^mC_{ds}T_{ds}G_{ds}A_{ds}G_{ds}G_{ds}T_{ds}A_{ds}T_{ds}A_{ks}A_{es}{}^mC_{ks}T_{es}G_k$ | 46 | 2802 |
| 1198370 | 2524 | 2539 | 123549 | 123564 | TGTCTCATGCCTTATA | $T_{ks}G_{ds}T_{ds}{}^mC_{ds}T_{ds}{}^mC_{ds}A_{ds}T_{ds}G_{ds}{}^mC_{ds}{}^mC_{ds}T_{ks}T_{es}A_{ks}T_{es}A_k$ | 20 | 2803 |
| 1198371 | 2526 | 2541 | 123551 | 123566 | ATTGTCTCATGCCTTA | $A_{ks}T_{ds}T_{ds}G_{ds}T_{ds}{}^mC_{ds}T_{ds}{}^mC_{ds}A_{ds}T_{ds}G_{ds}{}^mC_{ks}{}^mC_{es}T_{ks}T_{es}A_k$ | 15 | 2804 |
| 1198372 | 2527 | 2542 | 123552 | 123567 | AATTGTCTCATGCCTT | $A_{ks}A_{ds}T_{ds}T_{ds}G_{ds}T_{ds}{}^mC_{ds}T_{ds}{}^mC_{ds}A_{ds}T_{ds}G_{ks}{}^mC_{es}{}^mC_{ks}T_{es}T_k$ | 21 | 2805 |
| 1198373 | 2528 | 2543 | 123553 | 123568 | AAATTGTCTCATGCCT | $A_{ks}A_{ds}A_{ds}T_{ds}T_{ds}G_{ds}T_{ds}{}^mC_{ds}T_{ds}{}^mC_{ds}A_{ds}T_{ks}G_{es}{}^mC_{ks}{}^mC_{es}T_k$ | 40 | 443 |
| 1198374 | 2529 | 2544 | 123554 | 123569 | GAAATTGTCTCATGCC | $G_{ks}A_{ds}A_{ds}A_{ds}T_{ds}T_{ds}G_{ds}T_{ds}{}^mC_{ds}T_{ds}{}^mC_{ds}A_{ks}T_{es}G_{ks}{}^mC_{es}{}^mC_k$ | 24 | 2800 |
| 1198375 | 2530 | 2545 | 123555 | 123570 | GGAAATTGTCTCATGC | $G_{ks}G_{ds}A_{ds}A_{ds}A_{ds}T_{ds}T_{ds}G_{ds}T_{ds}{}^mC_{ds}T_{ds}{}^mC_{ds}A_{es}T_{ks}G_{es}{}^mC_k$ | 22 | 2806 |
| 1198376 | 2531 | 2546 | 123556 | 123571 | TGGAAATTGTCTCATG | $T_{ks}G_{ds}G_{ds}A_{ds}A_{ds}A_{ds}T_{ds}T_{ds}G_{ds}T_{ds}{}^mC_{ds}T_{ks}{}^mC_{es}A_{ks}T_{es}G_k$ | 36 | 2807 |
| 1198377 | 2532 | 2547 | 123557 | 123572 | ATGGAAATTGTCTCAT | $A_{ks}T_{ds}G_{ds}G_{ds}A_{ds}A_{ds}A_{ds}T_{ds}T_{ds}G_{ds}T_{ds}{}^mC_{ks}T_{es}{}^mC_{ks}A_{es}T_k$ | 30 | 2808 |
| 1198378 | 2534 | 2549 | 123559 | 123574 | ATATGGAAATTGTCTC | $A_{ks}T_{ds}A_{ds}T_{ds}G_{ds}G_{ds}A_{ds}A_{ds}A_{ds}T_{ds}T_{ds}G_{ks}T_{es}{}^mC_{ks}T_{es}{}^mC_k$ | 39 | 656 |
| 1198379 | 2560 | 2575 | 123585 | 123600 | AGTATGTGGCAATAAT | $A_{ks}G_{ds}T_{ds}A_{ds}T_{ds}G_{ds}T_{ds}G_{ds}G_{ds}{}^mC_{ds}A_{ds}A_{ks}T_{es}A_{ks}A_{es}T_k$ | 45 | 2809 |
| 1198380 | 2562 | 2577 | 123587 | 123602 | AGAGTATGTGGCAATA | $A_{ks}G_{ds}A_{ds}G_{ds}T_{ds}A_{ds}T_{ds}G_{ds}T_{ds}G_{ds}G_{ds}{}^mC_{ks}A_{es}A_{ks}T_{es}A_k$ | 18 | 2810 |
| 1198381 | 2563 | 2578 | 123588 | 123603 | TAGAGTATGTGGCAAT | $T_{ks}A_{ds}G_{ds}A_{ds}G_{ds}T_{ds}A_{ds}T_{ds}G_{ds}T_{ds}G_{ks}{}^mC_{es}A_{ks}A_{es}T_k$ | 19 | 2811 |
| 1198382 | 2564 | 2579 | 123589 | 123604 | TTAGAGTATGTGGCAA | $T_{ks}T_{ds}A_{ds}G_{ds}A_{ds}G_{ds}T_{ds}A_{ds}T_{ds}G_{ds}T_{ds}G_{ks}G_{es}{}^mC_{ks}A_{es}A_k$ | 19 | 963 |
| 1198383 | 2565 | 2580 | 123590 | 123605 | ATTAGAGTATGTGGCA | $A_{ks}T_{ds}T_{ds}A_{ds}G_{ds}A_{ds}G_{ds}T_{ds}A_{ds}T_{ds}G_{ds}T_{ds}G_{ks}G_{es}{}^mC_{es}A_k$ | 31 | 810 |
| 1198384 | 2566 | 2581 | 123591 | 123606 | TATTAGAGTATGTGGC | $T_{ks}A_{ds}T_{ds}T_{ds}A_{ds}G_{ds}A_{ds}G_{ds}T_{ds}A_{ds}T_{ds}G_{ks}T_{es}G_{ks}G_{es}{}^mC_k$ | 6 | 2812 |
| 1198385 | 2567 | 2582 | 123592 | 123607 | ATATTAGAGTATGTGG | $A_{ks}T_{ds}A_{ds}T_{ds}T_{ds}A_{ds}G_{ds}A_{ds}G_{ds}T_{ds}A_{ds}T_{ks}G_{es}T_{ks}G_{es}G_k$ | 30 | 2813 |
| 1198386 | 2568 | 2583 | 123593 | 123608 | TATATTAGAGTATGTG | $T_{ks}A_{ds}T_{ds}A_{ds}T_{ds}T_{ds}A_{ds}G_{ds}A_{ds}G_{ds}T_{ds}A_{ks}T_{es}G_{ks}T_{es}G_k$ | 77 | 2814 |
| 1198387 | 2570 | 2585 | 123595 | 123610 | TCTATATTAGAGTATG | $T_{ks}{}^mC_{ds}T_{ds}A_{ds}T_{ds}A_{ds}T_{ds}T_{ds}A_{ds}G_{ds}A_{ds}G_{ks}T_{es}A_{ks}T_{es}G_k$ | 84 | 887 |
| 1198388 | 4436 | 4451 | 125461 | 125476 | TATAACTGGGCAAATT | $T_{ks}A_{ds}T_{ds}A_{ds}A_{ds}{}^mC_{ds}T_{ds}G_{ds}G_{ds}G_{ds}{}^mC_{ds}A_{ks}A_{es}A_{ks}T_{es}T_k$ | 90 | 2815 |
| 1198389 | 4438 | 4453 | 125463 | 125478 | GGTATAACTGGGCAAA | $G_{ks}G_{ds}T_{ds}A_{ds}T_{ds}A_{ds}A_{ds}{}^mC_{ds}T_{ds}G_{ds}G_{ds}G_{ks}{}^mC_{es}A_{ks}A_{es}A_k$ | 28 | 1427 |
| 1198390 | 4439 | 4454 | 125464 | 125479 | AGGTATAACTGGGCAA | $A_{ks}G_{ds}G_{ds}T_{ds}A_{ds}T_{ds}A_{ds}A_{ds}{}^mC_{ds}T_{ds}G_{ds}G_{ks}G_{es}{}^mC_{ks}A_{es}A_k$ | 37 | 905 |
| 1198391 | 4440 | 4455 | 125465 | 125480 | GAGGTATAACTGGGCA | $G_{ks}A_{ds}G_{ds}G_{ds}T_{ds}A_{ds}T_{ds}A_{ds}A_{ds}{}^mC_{ds}T_{ds}G_{ks}G_{es}G_{ks}{}^mC_{es}A_k$ | 29 | 1503 |
| 1198392 | 4446 | 4461 | 125471 | 125486 | AACACTGAGGTATAAC | $A_{ks}A_{ds}{}^mC_{ds}A_{ds}{}^mC_{ds}T_{ds}G_{ds}A_{ds}G_{ds}G_{ds}T_{ds}A_{ks}T_{es}A_{ks}A_{es}{}^mC_k$ | 48 | 2816 |
| 1198393 | 4595 | 4610 | 125620 | 125635 | TTACATTAGGAACAAG | $T_{ks}T_{ds}A_{ds}{}^mC_{ds}A_{ds}T_{ds}T_{ds}A_{ds}G_{ds}G_{ds}A_{ds}A_{ks}{}^mC_{es}A_{ks}A_{es}G_k$ | 58 | 2817 |
| 1198394 | 4597 | 4612 | 125622 | 125637 | TTTTACATTAGGAACA | $T_{ks}T_{ds}T_{ds}T_{ds}A_{ds}{}^mC_{ds}A_{ds}T_{ds}T_{ds}A_{ds}G_{ds}G_{ks}A_{es}A_{ks}{}^mC_{es}A_k$ | 63 | 2818 |
| 1198395 | 4598 | 4613 | 125623 | 125638 | CTTTTACATTAGGAAC | ${}^mC_{ks}T_{ds}T_{ds}T_{ds}T_{ds}A_{ds}{}^mC_{ds}A_{ds}T_{ds}T_{ds}A_{ds}G_{ks}G_{es}A_{ks}A_{es}{}^mC_k$ | 35 | 1124 |
| 1198396 | 4599 | 4614 | 125624 | 125639 | ACTTTTACATTAGGAA | $A_{ks}{}^mC_{ds}T_{ds}T_{ds}T_{ds}T_{ds}A_{ds}{}^mC_{ds}A_{ds}T_{ds}T_{ds}A_{ks}G_{es}G_{ks}A_{es}A_k$ | 25 | 2819 |
| 1198397 | 4600 | 4615 | 125625 | 125640 | CACTTTTACATTAGGA | ${}^mC_{ks}A_{ds}{}^mC_{ds}T_{ds}T_{ds}T_{ds}T_{ds}A_{ds}{}^mC_{ds}A_{ds}T_{ds}T_{ks}A_{es}G_{ks}G_{es}A_k$ | 17 | 1200 |
| 1198398 | 4601 | 4616 | 125626 | 125641 | GCACTTTTACATTAGG | $G_{ks}{}^mC_{ds}A_{ds}{}^mC_{ds}T_{ds}T_{ds}T_{ds}T_{ds}A_{ds}{}^mC_{ds}A_{ds}T_{ks}T_{es}A_{ks}G_{es}G_k$ | 18 | 1276 |

TABLE 39-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198399 | 4602 | 4617 | 125627 | 125642 | AGCACTTTTACATTAG | $A_{ks}G_{ds}{}^mC_{ds}A_{ds}{}^mC_{ds}T_{ds}T_{ds}T_{ds}A_{ds}{}^mC_{ds}A_{ks}T_{es}T_{ks}A_{es}G_{k}$ | 35 | 2820 |
| 1198400 | 4603 | 4618 | 125628 | 125643 | AAGCACTTTTACATTA | $A_{ks}A_{ds}G_{ds}{}^mC_{ds}A_{ds}{}^mC_{ds}T_{ds}T_{ds}T_{ds}A_{ds}{}^mC_{ks}A_{es}T_{ks}A_{es}A_{k}$ | 62 | 2821 |
| 1198401 | 4605 | 4620 | 125630 | 125645 | TTAAGCACTTTTACAT | $T_{ks}T_{ds}A_{ds}A_{ds}G_{ds}{}^mC_{ds}A_{ds}{}^mC_{ds}T_{ds}T_{ds}T_{ks}A_{es}{}^mC_{ks}A_{es}T_{k}$ | 63 | 2822 |
| 1198402 | 4795 | 4810 | 125820 | 125835 | GGAAGATCTGAAACTC | $G_{ks}G_{ds}A_{ds}A_{ds}G_{ds}A_{ds}T_{ds}{}^mC_{ds}T_{ds}G_{ds}A_{ds}A_{ks}A_{es}{}^mC_{ks}T_{es}{}^mC_{k}$ | 32 | 2823 |
| 1198403 | 4797 | 4812 | 125822 | 125837 | TTGGAAGATCTGAAAC | $T_{ks}T_{ds}G_{ds}G_{ds}A_{ds}A_{ds}G_{ds}A_{ds}T_{ds}{}^mC_{ds}T_{ds}G_{ks}A_{es}A_{ks}A_{es}{}^mC_{k}$ | 54 | 2824 |
| 1198404 | 4798 | 4813 | 125823 | 125838 | TTTGGAAGATCTGAAA | $T_{ks}T_{ds}T_{ds}G_{ds}G_{ds}A_{ds}A_{ds}G_{ds}A_{ds}T_{ds}{}^mC_{ds}T_{ks}G_{es}A_{ks}A_{es}A_{k}$ | 55 | 2825 |
| 1198405 | 4799 | 4814 | 125824 | 125839 | CTTTGGAAGATCTGAA | ${}^mC_{ks}T_{ds}T_{ds}T_{ds}G_{ds}G_{ds}A_{ds}A_{ds}G_{ds}A_{ds}T_{ds}{}^mC_{ks}T_{es}G_{ks}A_{es}A_{k}$ | 36 | 2826 |
| 1198406 | 4800 | 4815 | 125825 | 125840 | GCTTTGGAAGATCTGA | $G_{ks}{}^mC_{ds}T_{ds}T_{ds}T_{ds}G_{ds}G_{ds}A_{ds}A_{ds}G_{ds}A_{ds}T_{ks}{}^mC_{es}T_{ks}G_{es}A_{k}$ | 17 | 2044 |
| 1198407 | 4801 | 4816 | 125826 | 125841 | TGCTTTGGAAGATCTG | $T_{ks}G_{ds}{}^mC_{ds}T_{ds}T_{ds}T_{ds}G_{ds}G_{ds}A_{ds}A_{ds}G_{ds}A_{ds}A_{ks}T_{es}{}^mC_{ks}T_{es}G_{k}$ | 23 | 2121 |
| 1198408 | 4802 | 4817 | 125827 | 125842 | GTGCTTTGGAAGATCT | $G_{ks}T_{ds}G_{ds}{}^mC_{ds}T_{ds}T_{ds}T_{ds}G_{ds}G_{ds}A_{ds}A_{ds}G_{ks}A_{es}T_{ks}{}^mC_{es}T_{k}$ | 41 | 2827 |
| 1198409 | 4803 | 4818 | 125828 | 125843 | AGTGCTTTGGAAGATC | $A_{ks}G_{ds}T_{ds}G_{ds}{}^mC_{ds}T_{ds}T_{ds}T_{ds}G_{ds}G_{ds}A_{ds}A_{ks}G_{es}A_{ks}T_{es}{}^mC_{k}$ | 19 | 2828 |
| 1198410 | 4805 | 4820 | 125830 | 125845 | ATAGTGCTTTGGAAGA | $A_{ks}T_{ds}A_{ds}G_{ds}T_{ds}G_{ds}{}^mC_{ds}T_{ds}T_{ds}T_{ds}G_{ds}G_{ks}A_{es}A_{ks}G_{es}A_{k}$ | 48 | 2829 |
| 1198411 | N/A | N/A | 94729 | 94744 | AGGATGCATGGTTTTT | $A_{ks}G_{ds}G_{ds}A_{ds}T_{ds}G_{ds}{}^mC_{ds}A_{ds}T_{ds}G_{ds}G_{ks}T_{es}T_{ks}T_{es}T_{k}$ | 33 | 2830 |
| 1198412 | N/A | N/A | 94731 | 94746 | TTAGGATGCATGGTTT | $T_{ks}T_{ds}A_{ds}G_{ds}G_{ds}A_{ds}T_{ds}G_{ds}{}^mC_{ds}A_{ds}T_{ds}G_{ks}G_{es}T_{ks}T_{es}T_{k}$ | 17 | 2831 |
| 1198413 | N/A | N/A | 94732 | 94747 | TTTAGGATGCATGGTT | $T_{ks}T_{ds}T_{ds}A_{ds}G_{ds}G_{ds}A_{ds}T_{ds}G_{ds}{}^mC_{ds}A_{ds}T_{ks}G_{es}G_{ks}T_{es}T_{k}$ | 29 | 2832 |
| 1198414 | N/A | N/A | 94733 | 94748 | ATTTAGGATGCATGGT | $A_{ks}T_{ds}T_{ds}T_{ds}A_{ds}G_{ds}G_{ds}A_{ds}T_{ds}G_{ds}{}^mC_{ds}A_{ks}T_{es}G_{ks}G_{es}T_{k}$ | 20 | 2833 |
| 1198415 | N/A | N/A | 94734 | 94749 | GATTTAGGATGCATGG | $G_{ks}A_{ds}T_{ds}T_{ds}T_{ds}A_{ds}G_{ds}G_{ds}A_{ds}T_{ds}G_{ds}{}^mC_{ks}A_{es}T_{ks}G_{es}G_{k}$ | 29 | 2834 |
| 1198416 | N/A | N/A | 94735 | 94750 | AGATTTAGGATGCATG | $A_{ks}G_{ds}A_{ds}T_{ds}T_{ds}T_{ds}A_{ds}G_{ds}G_{ds}A_{ds}T_{ds}G_{ks}{}^mC_{es}A_{ks}T_{es}G_{k}$ | 29 | 2835 |
| 1198417 | N/A | N/A | 94736 | 94751 | CAGATTTAGGATGCAT | ${}^mC_{ks}A_{ds}G_{ds}A_{ds}T_{ds}T_{ds}T_{ds}A_{ds}G_{ds}G_{ds}A_{ds}T_{ks}G_{es}{}^mC_{ks}A_{es}T_{k}$ | 40 | 2836 |
| 1198418 | N/A | N/A | 94737 | 94752 | TCAGATTTAGGATGCA | $T_{ks}{}^mC_{ds}A_{ds}G_{ds}A_{ds}T_{ds}T_{ds}T_{ds}A_{ds}G_{ds}G_{ds}A_{ks}T_{es}G_{ks}{}^mC_{es}A_{k}$ | 67 | 2837 |
| 1198419 | N/A | N/A | 94739 | 94754 | ATTCAGATTTAGGATG | $A_{ks}T_{ds}T_{ds}{}^mC_{ds}A_{ds}G_{ds}A_{ds}T_{ds}T_{ds}T_{ds}A_{ds}G_{ks}G_{es}A_{ks}T_{es}G_{k}$ | 78 | 2838 |
| 1198420 | N/A | N/A | 115903 | 115918 | ATATGGTTTTGTGTGT | $A_{ks}T_{ds}A_{ds}T_{ds}G_{ds}G_{ds}T_{ds}T_{ds}T_{ds}T_{ds}G_{ds}T_{ks}G_{es}T_{ks}G_{es}T_{k}$ | 41 | 2839 |
| 1198421 | N/A | N/A | 115905 | 115920 | TTATATGGTTTTGTGT | $T_{ks}T_{ds}A_{ds}T_{ds}A_{ds}T_{ds}G_{ds}G_{ds}T_{ds}T_{ds}T_{ds}T_{ks}G_{es}T_{ks}G_{es}T_{k}$ | 36 | 2840 |
| 1198422 | N/A | N/A | 115906 | 115921 | CTTATATGGTTTTGTG | ${}^mC_{ks}T_{ds}T_{ds}A_{ds}T_{s}A_{ds}T_{ds}G_{ds}G_{ds}T_{ds}T_{ds}T_{ks}T_{es}G_{ks}T_{es}G_{k}$ | 18 | 2788 |
| 1198423 | N/A | N/A | 115907 | 115922 | TCTTATATGGTTTTGT | $T_{ks}{}^mC_{ds}T_{ds+IIs}A_{ds}T_{ds}A_{ds}T_{ds}G_{ds}G_{ds}T_{ds}T_{ks}T_{es}T_{ks}G_{es}T_{k}$ | 10 | 2841 |
| 1198424 | N/A | N/A | 115908 | 115923 | CTCTTATATGGTTTTG | ${}^mC_{ks}T_{ds}{}^mC_{ds}T_{ds}T_{ds}A_{ds}T_{ds}A_{ds}T_{ds}G_{ds}G_{ds}T_{ks}T_{es}T_{ks}T_{es}G_{k}$ | 15 | 2842 |
| 1198429 | N/A | N/A | 117325 | 117340 | ATTGCAATCTGTCTGA | $A_{ks}T_{ds}T_{ds}G_{ds}{}^mC_{ds}A_{ds}A_{ds}T_{ds}{}^mC_{ds}T_{ds}G_{ds}T_{ks}{}^mC_{es}T_{ks}G_{es}A_{k}$ | 48 | 2843 |
| 1198430 | N/A | N/A | 117327 | 117342 | ATATTGCAATCTGTCT | $A_{ks}T_{ds}A_{ds}T_{ds}T_{ds}G_{ds}{}^mC_{ds}A_{ds}A_{ds}T_{ds}{}^mC_{ds}T_{ks}G_{es}T_{ks}{}^mC_{es}T_{k}$ | 49 | 2844 |
| 1198431 | N/A | N/A | 117328 | 117343 | AATATTGCAATCTGTC | $A_{ks}A_{ds}T_{ds}A_{ds}T_{ds}T_{ds}G_{ds}{}^mC_{ds}A_{ds}A_{ds}T_{ds}{}^mC_{ks}T_{es}G_{ks}T_{es}{}^mC_{k}$ | 35 | 2845 |
| 1198432 | N/A | N/A | 117329 | 117344 | TAATATTGCAATCTGT | $T_{ks}A_{ds}A_{ds}T_{ds}A_{ds}T_{ds}T_{ds}G_{ds}{}^mC_{ds}A_{ds}A_{ds}T_{ks}{}^mC_{es}T_{ks}G_{es}T_{k}$ | 70 | 2846 |
| 1198433 | N/A | N/A | 117330 | 117345 | GTAATATTGCAATCTG | $G_{ks}T_{ds}A_{ds}A_{ds}T_{ds}A_{ds}T_{ds}T_{ds}G_{ds}{}^mC_{ds}A_{ds}A_{ks}T_{es}{}^mC_{ks}T_{es}G_{k}$ | 36 | 1404 |
| 1198434 | N/A | N/A | 117331 | 117346 | TGTAATATTGCAATCT | $T_{ks}G_{ds}T_{ds}A_{ds}A_{ds}T_{ds}A_{ds}T_{ds}T_{ds}G_{ds}{}^mC_{ds}A_{ks}A_{es}T_{ks}{}^mC_{es}T_{k}$ | 78 | 2847 |
| 1198435 | N/A | N/A | 117332 | 117347 | ATGTAATATTGCAATC | $A_{ks}T_{ds}G_{ds}T_{ds}A_{ds}A_{ds}T_{ds}A_{ds}T_{ds}T_{ds}G_{ds}{}^mC_{ks}A_{es}A_{ks}T_{es}{}^mC_{k}$ | 57 | 2848 |
| 1198436 | N/A | N/A | 117333 | 117348 | TATGTAATATTGCAAT | $T_{ks}A_{ds}T_{ds}G_{ds}T_{ds}A_{ds}A_{ds}T_{ds}A_{ds}T_{ds}T_{ds}G_{ks}{}^mC_{es}A_{ks}A_{es}T_{k}$ | 69 | 2849 |
| 1198437 | N/A | N/A | 117335 | 117350 | TTTATGTAATATTGCA | $T_{ks}T_{ds}T_{ds}A_{ds}T_{ds}G_{ds}T_{ds}A_{ds}A_{ds}T_{ds}A_{ds}T_{ks}T_{es}G_{ks}{}^mC_{es}A_{k}$ | 63 | 2850 |
| 1198447 | N/A | N/A | 119667 | 119682 | TAAGGTTTCCCAGATT | $T_{ks}A_{ds}A_{ds}G_{ds}G_{ds}T_{ds}T_{ds}T_{s}{}^mC_{ds}{}^mC_{ds}{}^mC_{ds}A_{ks}G_{es}A_{ks}T_{es}T_{k}$ | 63 | 2851 |

TABLE 39-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198448 | N/A | N/A | 119669 | 119684 | AGTAAGGTTTCCCAGA | $A_{ks}G_{ds}T_{ds}A_{ds}A_{ds}G_{ds}G_{ds}T_{ds}T_{ds}T_{ds}{}^{m}C_{ds}{}^{m}C_{ks}{}^{m}C_{es}A_{ks}G_{es}A_{k}$ | 36 | 2852 |
| 1198449 | N/A | N/A | 119670 | 119685 | AAGTAAGGTTTCCCAG | $A_{ks}A_{ds}G_{ds}T_{ds}A_{ds}A_{ds}G_{ds}G_{ds}T_{ds}T_{ds}T_{ds}{}^{m}C_{ks}{}^{m}C_{es}{}^{m}C_{ks}A_{es}G_{k}$ | 37 | 2853 |
| 1198450 | N/A | N/A | 119671 | 119686 | TAAGTAAGGTTTCCCA | $T_{ks}A_{ds}A_{ds}G_{ds}T_{ds}A_{ds}A_{ds}G_{ds}G_{ds}T_{ds}T_{ds}T_{ks}{}^{m}C_{es}{}^{m}C_{ks}{}^{m}C_{es}A_{k}$ | 42 | 2854 |
| 1198451 | N/A | N/A | 119672 | 119687 | CTAAGTAAGGTTTCCC | ${}^{m}C_{ks}T_{ds}A_{ds}A_{ds}G_{ds}T_{ds}A_{ds}A_{ds}G_{ds}T_{ds}T_{ks}T_{es}{}^{m}C_{es}{}^{m}C_{k}$ | 48 | 1101 |
| 1198452 | N/A | N/A | 119673 | 119688 | ACTAAGTAAGGTTTCC | $A_{ks}{}^{m}C_{ds}T_{ds}A_{ds}A_{ds}G_{ds}T_{ds}A_{ds}A_{ds}G_{ds}T_{ks}T_{es}T_{ks}{}^{m}C_{es}{}^{m}C_{k}$ | 38 | 2855 |
| 1198453 | N/A | N/A | 119674 | 119689 | GACTAAGTAAGGTTTC | $G_{ks}A_{ds}{}^{m}C_{ds}T_{ds}A_{ds}A_{ds}G_{ds}T_{ds}A_{ds}A_{ds}G_{ds}G_{ks}T_{es}T_{ks}T_{es}{}^{m}C_{k}$ | 48 | 2856 |
| 1198454 | N/A | N/A | 119675 | 119690 | AGACTAAGTAAGGTTT | $A_{ks}G_{ds}A_{ds}{}^{m}C_{ds}T_{ds}A_{ds}A_{ds}G_{ds}T_{ds}A_{ds}A_{ds}G_{ks}G_{es}T_{ks}T_{es}T_{k}$ | 39 | 2857 |
| 1198455 | N/A | N/A | 119677 | 119692 | TTAGACTAAGTAAGGT | $T_{ks}T_{ds}A_{ds}G_{ds}A_{ds}{}^{m}C_{ds}T_{ds}A_{ds}A_{ds}G_{ds}T_{ds}A_{ks}A_{es}G_{ks}G_{es}T_{k}$ | 42 | 2858 |

TABLE 40

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^{m}C_{ds}T_{ds}T_{ds}{}^{m}C_{ds}A_{ds}T_{ds}A_{ds}G_{ds}{}^{m}C_{ds}T_{ks}T_{ks}A_{k}$ | 28 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^{m}C_{ks}A_{k}$ | 15 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^{m}C_{ds}T_{ds}{}^{m}C_{ds}A_{ds}T_{ds}G_{ks}{}^{m}C_{ks}{}^{m}C_{k}$ | 9 | 2800 |
| 1198425 | N/A | N/A | 115909 | 115924 | ACTCTTATATGGTTTT | $A_{ks}{}^{m}C_{ds}T_{ds}{}^{m}C_{ds}T_{ds}T_{ds}A_{ds}T_{ds}A_{ds}T_{ds}G_{ds}G_{ks}T_{es}T_{ks}T_{es}T_{k}$ | 35 | 2859 |
| 1198426 | N/A | N/A | 115910 | 115925 | AACTCTTATATGGTTT | $A_{ks}A_{ds}{}^{m}C_{ds}T_{ds}{}^{m}C_{ds}T_{ds}T_{ds}A_{ds}T_{ds}A_{ds}T_{ds}G_{ks}G_{es}T_{ks}T_{es}T_{k}$ | 111 | 2860 |
| 1198427 | N/A | N/A | 115911 | 115926 | CAACTCTTATATGGTT | ${}^{m}C_{ks}A_{ds}A_{ds}{}^{m}C_{ds}T_{ds}{}^{m}C_{ds}T_{ds}T_{ds}A_{ds}T_{ds}A_{ds}T_{ks}G_{es}G_{ks}T_{es}T_{k}$ | 62 | 2861 |
| 1198428 | N/A | N/A | 115913 | 115928 | GACAACTCTTATATGG | $G_{ks}A_{ds}{}^{m}C_{ds}A_{ds}A_{ds}{}^{m}C_{ds}T_{ds}{}^{m}C_{ds}T_{ds}T_{ds}A_{ds}T_{ks}A_{ds}T_{ks}G_{es}G_{k}$ | 62 | 2862 |
| 1198438 | N/A | N/A | 117755 | 117770 | TGTATGTCAGAAGAGT | $T_{ks}G_{ds}T_{ds}A_{ds}T_{ds}G_{ds}T_{ds}{}^{m}C_{ds}A_{ds}G_{ds}A_{ds}A_{ks}G_{es}A_{ks}G_{es}T_{k}$ | 7 | 2863 |
| 1198439 | N/A | N/A | 117757 | 117772 | AGTGTATGTCAGAAGA | $A_{ks}G_{ds}T_{ds}G_{ds}T_{ds}A_{ds}T_{ds}G_{ds}T_{ds}{}^{m}C_{ds}A_{ds}G_{ds}{}^{m}C_{ds}A_{ds}G_{ks}A_{es}A_{ks}G_{es}A_{k}$ | 6 | 2864 |
| 1198440 | N/A | N/A | 117758 | 117773 | AAGTGTATGTCAGAAG | $A_{ks}A_{ds}G_{ds}T_{ds}G_{ds}T_{ds}A_{ds}T_{ds}G_{ds}T_{ds}{}^{m}C_{ds}A_{ks}G_{es}A_{ks}A_{es}G_{k}$ | 5 | 2865 |
| 1198441 | N/A | N/A | 117759 | 117774 | AAAGTGTATGTCAGAA | $A_{ks}A_{ds}A_{ds}G_{ds}T_{ds}G_{ds}T_{ds}A_{ds}T_{ds}G_{ds}T_{ds}{}^{m}C_{ds}A_{ds}G_{ds}T_{ds}{}^{m}C_{ks}A_{es}G_{ks}A_{es}A_{k}$ | 19 | 2866 |
| 1198442 | N/A | N/A | 117760 | 117775 | TAAAGTGTATGTCAGA | $T_{ks}A_{ds}A_{ds}A_{ds}G_{ds}T_{ds}G_{ds}T_{ds}A_{ds}T_{ds}G_{ds}T_{ks}{}^{m}C_{es}A_{ks}G_{es}A_{k}$ | 44 | 2867 |
| 1198443 | N/A | N/A | 117761 | 117776 | TTAAAGTGTATGTCAG | $T_{ks}T_{ds}A_{ds}A_{ds}A_{ds}G_{ds}T_{ds}G_{ds}T_{ds}A_{ds}T_{ds}G_{ks}T_{es}{}^{m}C_{ks}A_{es}G_{k}$ | 39 | 2868 |
| 1198444 | N/A | N/A | 117762 | 117777 | TTTAAAGTGTATGTCA | $T_{ks}T_{ds}T_{ds}A_{ds}A_{ds}A_{ds}G_{ds}T_{ds}G_{ds}T_{ds}A_{ds}T_{ks}G_{es}T_{ks}{}^{m}C_{es}A_{k}$ | 70 | 2869 |
| 1198445 | N/A | N/A | 117763 | 117778 | CTTTAAAGTGTATGTC | ${}^{m}C_{ks}T_{ds}T_{ds}T_{ds}A_{ds}A_{ds}A_{ds}G_{ds}T_{ds}G_{ds}T_{ds}A_{ks}T_{es}G_{ks}T_{es}{}^{m}C_{k}$ | 61 | 1634 |
| 1198446 | N/A | N/A | 117765 | 117780 | AACTTTAAAGTGTATG | $A_{ks}A_{ds}{}^{m}C_{ds}T_{ds}T_{ds}T_{ds}A_{ds}A_{ds}A_{ds}G_{ds}T_{ds}G_{ks}T_{es}A_{ks}T_{es}G_{k}$ | 83 | 2870 |
| 1198714 | 2524 | 2539 | 123549 | 123564 | TGTCTCATGCCTTATA | $T_{ks}G_{es}T_{ks}{}^{m}C_{ds}T_{ds}{}^{m}C_{ds}A_{ds}T_{ds}G_{ds}{}^{m}C_{ds}{}^{m}C_{ds}T_{ds}T_{es}A_{es}T_{ks}A_{k}$ | 20 | 2803 |
| 1198715 | 2526 | 2541 | 123551 | 123566 | ATTGTCTCATGCCTTA | $A_{ks}T_{es}T_{ks}G_{ds}T_{ds}{}^{m}C_{ds}T_{ds}{}^{m}C_{ds}A_{ds}T_{ds}G_{ds}{}^{m}C_{ds}{}^{m}C_{ds}T_{es}T_{es}T_{ks}A_{k}$ | 33 | 2804 |
| 1198716 | 2527 | 2542 | 123552 | 123567 | AATTGTCTCATGCCTT | $A_{ks}A_{es}T_{ks}T_{ds}G_{ds}T_{ds}{}^{m}C_{ds}T_{ds}{}^{m}C_{ds}A_{ds}T_{ds}G_{ds}{}^{m}C_{es}{}^{m}C_{es}T_{ks}T_{k}$ | 27 | 2805 |
| 1198717 | 2528 | 2543 | 123553 | 123568 | AAATTGTCTCATGCCT | $A_{ks}A_{es}A_{ks}T_{ds}T_{ds}G_{ds}T_{ds}{}^{m}C_{ds}T_{ds}{}^{m}C_{ds}A_{ds}T_{ds}G_{es}{}^{m}C_{es}{}^{m}C_{ks}T_{k}$ | 41 | 443 |
| 1198718 | 2529 | 2544 | 123554 | 123569 | GAAATTGTCTCATGCC | $G_{ks}A_{es}A_{ks}A_{ds}T_{ds}T_{ds}G_{ds}T_{ds}{}^{m}C_{ds}T_{ds}{}^{m}C_{ds}A_{ds}T_{es}G_{es}{}^{m}C_{ks}{}^{m}C_{k}$ | 9 | 2800 |

TABLE 40-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198719 | 2530 | 2545 | 123555 | 123570 | GGAAATTGTCTCATGC | $G_{ks}G_{es}A_{ks}A_{ds}A_{ds}T_{ds}T_{ds}G_{ds}T_{ds}{}^mC_{ds}T_{ds}{}^mC_{ds}A_{es}T_{es}G_{ks}{}^mC_k$ | 14 | 2806 |
| 1198720 | 2531 | 2546 | 123556 | 123571 | TGGAAATTGTCTCATG | $T_{ks}G_{es}G_{ks}A_{ds}A_{ds}A_{ds}T_{ds}T_{ds}G_{ds}T_{ds}{}^mC_{ds}T_{ds}{}^mC_{es}A_{es}T_{ks}G_k$ | 21 | 2807 |
| 1198721 | 2532 | 2547 | 123557 | 123572 | ATGGAAATTGTCTCAT | $A_{ks}T_{es}G_{ks}G_{ds}A_{ds}A_{ds}A_{ds}T_{ds}T_{ds}G_{ds}T_{ds}{}^mC_{ds}T_{es}{}^mC_{es}A_{ks}T_k$ | 48 | 2808 |
| 1198722 | 2534 | 2549 | 123559 | 123574 | ATATGGAAATTGTCTC | $A_{ks}T_{es}A_{ks}T_{ds}G_{ds}G_{ds}A_{ds}A_{ds}A_{ds}T_{ds}T_{ds}G_{ds}T_{es}{}^mC_{es}T_{ks}{}^mC_k$ | 48 | 656 |
| 1198723 | 2560 | 2575 | 123585 | 123600 | AGTATGTGGCAATAAT | $A_{ks}G_{es}T_{ks}A_{ds}T_{ds}G_{ds}T_{ds}G_{ds}G_{ds}{}^mC_{ds}A_{ds}A_{ds}T_{es}A_{es}A_{ks}T_k$ | 57 | 2809 |
| 1198724 | 2562 | 2577 | 123587 | 123602 | AGAGTATGTGGCAATA | $A_{ks}G_{es}A_{ks}G_{ds}T_{ds}A_{ds}T_{ds}G_{ds}T_{ds}G_{ds}G_{ds}{}^mC_{ds}A_{es}A_{es}T_{ks}A_k$ | 16 | 2810 |
| 1198725 | 2563 | 2578 | 123588 | 123603 | TAGAGTATGTGGCAAT | $T_{ks}A_{es}G_{ks}A_{ds}G_{ds}T_{ds}A_{ds}T_{ds}G_{ds}T_{ds}G_{ds}G_{ds}{}^mC_{es}A_{es}A_{ks}T_k$ | 23 | 2811 |
| 1198726 | 2564 | 2579 | 123589 | 123604 | TTAGAGTATGTGGCAA | $T_{ks}T_{es}A_{ks}G_{ds}A_{ds}G_{ds}T_{ds}A_{ds}T_{ds}G_{ds}T_{ds}G_{ds}G_{es}{}^mC_{es}A_{ks}A_k$ | 28 | 963 |
| 1198727 | 2565 | 2580 | 123590 | 123605 | ATTAGAGTATGTGGCA | $A_{ks}T_{es}T_{ks}A_{ds}G_{ds}A_{ds}G_{ds}T_{ds}A_{ds}T_{ds}G_{ds}T_{ds}G_{es}G_{es}{}^mC_{ks}A_k$ | 19 | 810 |
| 1198728 | 2566 | 2581 | 123591 | 123606 | TATTAGAGTATGTGGC | $T_{ks}A_{es}T_{ks}T_{ds}A_{ds}G_{ds}A_{ds}G_{ds}T_{ds}A_{ds}T_{ds}G_{ds}T_{es}G_{es}G_{ks}{}^mC_k$ | 17 | 2812 |
| 1198729 | 2567 | 2582 | 123592 | 123607 | ATATTAGAGTATGTGG | $A_{ks}T_{es}A_{ks}T_{ds}T_{ds}A_{ds}G_{ds}A_{ds}G_{ds}T_{ds}A_{ds}T_{ds}G_{es}T_{es}G_{ks}G_k$ | 21 | 2813 |
| 1198730 | 2568 | 2583 | 123593 | 123608 | TATATTAGAGTATGTG | $T_{ks}A_{es}T_{ks}A_{ds}T_{ds}T_{ds}A_{ds}G_{ds}A_{ds}G_{ds}T_{ds}A_{ds}T_{es}G_{es}T_{ks}G_k$ | 57 | 2814 |
| 1198731 | 2570 | 2585 | 123595 | 123610 | TCTATATTAGAGTATG | $T_{ks}{}^mC_{es}T_{ks}A_{ds}T_{ds}A_{ds}T_{ds}T_{ds}A_{ds}G_{ds}A_{ds}G_{ds}T_{es}A_{es}T_{ks}G_k$ | 59 | 887 |
| 1198732 | 4436 | 4451 | 125461 | 125476 | TATAACTGGGCAAATT | $T_{ks}A_{es}T_{ks}A_{ds}A_{ds}{}^mC_{ds}T_{ds}G_{ds}G_{ds}G_{ds}{}^mC_{ds}A_{ds}A_{es}A_{es}T_{ks}T_k$ | 86 | 2815 |
| 1198741 | 4595 | 4610 | 125620 | 125635 | TTACATTAGGAACAAG | $T_{ks}T_{es}A_{ks}{}^mC_{ds}A_{ds}T_{ds}T_{ds}A_{ds}G_{ds}G_{ds}A_{ds}A_{ds}{}^mC_{es}A_{es}A_{ks}G_k$ | 60 | 2817 |
| 1198742 | 4597 | 4612 | 125622 | 125637 | TTTTACATTAGGAACA | $T_{ks}T_{es}T_{ks}T_{ds}A_{ds}{}^mC_{ds}A_{ds}T_{ds}T_{ds}A_{ds}G_{ds}G_{ds}A_{es}A_{es}{}^mC_{ks}A_k$ | 143 | 2818 |
| 1198743 | 4598 | 4613 | 125623 | 125638 | CTTTTACATTAGGAAC | ${}^mC_{ks}T_{es}T_{ks}T_{ds}T_{ds}A_{ds}{}^mC_{ds}A_{ds}T_{ds}T_{ds}A_{ds}G_{ds}G_{es}A_{es}A_{ks}{}^mC_k$ | 86 | 1124 |
| 1198744 | 4599 | 4614 | 125624 | 125639 | ACTTTTACATTAGGAA | $A_{ks}{}^mC_{es}T_{ks}T_{ds}T_{ds}T_{ds}A_{ds}{}^mC_{ds}A_{ds}T_{ds}T_{ds}A_{ds}G_{es}G_{es}A_{ks}A_k$ | 66 | 2819 |
| 1198745 | 4600 | 4615 | 125625 | 125640 | CACTTTTACATTAGGA | ${}^mC_{ks}A_{es}{}^mC_{ks}T_{ds}T_{ds}T_{ds}T_{ds}A_{ds}{}^mC_{ds}A_{ds}T_{ds}T_{ds}A_{es}G_{es}G_{ks}A_k$ | 57 | 1200 |
| 1198746 | 4601 | 4616 | 125626 | 125641 | GCACTTTTACATTAGG | $G_{ks}{}^mC_{es}A_{ks}{}^mC_{ds}T_{ds}T_{ds}T_{ds}T_{ds}A_{ds}{}^mC_{ds}A_{ds}T_{ds}T_{es}A_{es}G_{ks}G_k$ | 7 | 1276 |
| 1198747 | 4602 | 4617 | 125627 | 125642 | AGCACTTTTACATTAG | $A_{ks}G_{es}{}^mC_{ks}A_{ds}{}^mC_{ds}T_{ds}T_{ds}T_{ds}T_{ds}A_{ds}{}^mC_{ds}A_{ds}T_{es}T_{es}A_{ks}G_k$ | 38 | 2820 |
| 1198748 | 4603 | 4618 | 125628 | 125643 | AAGCACTTTTACATTA | $A_{ks}A_{es}G_{ks}{}^mC_{ds}A_{ds}{}^mC_{ds}T_{ds}T_{ds}T_{ds}T_{ds}A_{ds}{}^mC_{ds}A_{es}T_{es}T_{ks}A_k$ | 81 | 2821 |
| 1198749 | 4605 | 4620 | 125630 | 125645 | TTAAGCACTTTTACAT | $T_{ks}T_{es}A_{ks}A_{ds}G_{ds}{}^mC_{ds}A_{ds}{}^mC_{ds}T_{ds}T_{ds}T_{ds}T_{ds}A_{es}{}^mC_{es}A_{ks}T_k$ | 73 | 2822 |
| 1198750 | 4795 | 4810 | 125820 | 125835 | GGAAGATCTGAAACTC | $G_{ks}G_{es}A_{ks}A_{ds}G_{ds}A_{ds}T_{ds}{}^mC_{ds}T_{ds}G_{ds}A_{ds}A_{ds}A_{es}{}^mC_{es}T_{ks}{}^mC_k$ | 32 | 2823 |
| 1198751 | 4797 | 4812 | 125822 | 125837 | TTGGAAGATCTGAAAC | $T_{ks}T_{es}G_{ks}G_{ds}A_{ds}A_{ds}G_{ds}A_{ds}T_{ds}{}^mC_{ds}T_{ds}G_{ds}A_{es}A_{es}A_{ks}{}^mC_k$ | 76 | 2824 |
| 1198752 | 4798 | 4813 | 125823 | 125838 | TTTGGAAGATCTGAAA | $T_{ks}T_{es}T_{ks}G_{ds}G_{ds}A_{ds}A_{ds}G_{ds}A_{ds}T_{ds}{}^mC_{ds}T_{ds}G_{es}A_{es}A_{ks}A_k$ | 111 | 2825 |
| 1198753 | 4799 | 4814 | 125824 | 125839 | CTTTGGAAGATCTGAA | ${}^mC_{ks}T_{es}T_{ks}T_{ds}G_{ds}G_{ds}A_{ds}A_{ds}G_{ds}A_{ds}T_{ds}{}^mC_{ds}T_{es}G_{es}A_{ks}A_k$ | 58 | 2826 |
| 1198754 | 4800 | 4815 | 125825 | 125840 | GCTTTGGAAGATCTGA | $G_{ks}{}^mC_{es}T_{ks}T_{ds}T_{ds}G_{ds}G_{ds}A_{ds}A_{ds}G_{ds}A_{ds}T_{ds}{}^mC_{es}T_{es}G_{ks}A_k$ | 23 | 2044 |
| 1198755 | 4801 | 4816 | 125826 | 125841 | TGCTTTGGAAGATCTG | $T_{ks}G_{es}{}^mC_{ks}T_{ds}T_{ds}T_{ds}G_{ds}G_{ds}A_{ds}A_{ds}G_{ds}A_{ds}T_{es}{}^mC_{es}T_{ks}G_k$ | 32 | 2121 |
| 1198756 | 4802 | 4817 | 125827 | 125842 | GTGCTTTGGAAGATCT | $G_{ks}T_{es}G_{ks}{}^mC_{ds}T_{ds}T_{ds}T_{ds}G_{ds}G_{ds}A_{ds}A_{ds}G_{ds}A_{es}T_{es}{}^mC_{ks}T_k$ | 50 | 2827 |
| 1198757 | 4803 | 4818 | 125828 | 125843 | AGTGCTTTGGAAGATC | $A_{ks}G_{es}T_{ks}G_{ds}{}^mC_{ds}T_{ds}T_{ds}T_{ds}G_{ds}G_{ds}A_{ds}A_{ds}G_{es}A_{es}T_{ks}{}^mC_k$ | 4 | 2828 |
| 1198758 | 4805 | 4820 | 125830 | 125845 | ATAGTGCTTTGGAAGA | $A_{ks}T_{es}A_{ks}G_{ds}T_{ds}G_{ds}{}^mC_{ds}T_{ds}T_{ds}T_{ds}G_{ds}G_{ds}A_{es}A_{es}G_{ks}A_k$ | 47 | 2829 |
| 1198759 | N/A | N/A | 94729 | 94744 | AGGATGCATGGTTTTT | $A_{ks}G_{es}G_{ks}A_{ds}T_{ds}G_{ds}{}^mC_{ds}A_{ds}T_{ds}G_{ds}G_{ds}T_{ds}T_{es}T_{es}T_{ks}T_k$ | 27 | 2830 |
| 1198760 | N/A | N/A | 94731 | 94746 | TTAGGATGCATGGTTT | $T_{ks}T_{es}A_{ks}G_{ds}G_{ds}A_{ds}T_{ds}G_{ds}{}^mC_{ds}A_{ds}T_{ds}G_{ds}G_{es}T_{es}T_{ks}T_k$ | 91 | 2831 |
| 1198761 | N/A | N/A | 94732 | 94747 | TTTAGGATGCATGGTT | $T_{ks}T_{es}T_{ks}A_{ds}G_{ds}G_{ds}A_{ds}T_{ds}G_{ds}{}^mC_{ds}A_{ds}T_{ds}G_{es}G_{es}T_{ks}T_k$ | 42 | 2832 |
| 1198762 | N/A | N/A | 94733 | 94748 | ATTTAGGATGCATGGT | $A_{ks}T_{es}T_{ks}T_{ds}A_{ds}G_{ds}G_{ds}A_{ds}T_{ds}G_{ds}{}^mC_{ds}A_{ds}T_{es}G_{es}G_{ks}T_k$ | 30 | 2833 |

TABLE 40-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198763 | N/A | N/A | 94734 | 94749 | GATTTAGGATGCATGG | $G_{ks}A_{es}T_{ks}T_{ds}T_{ds}A_{ds}G_{ds}G_{ds}A_{ds}T_{ds}G_{ds}{}^mC_{ds}A_{es}T_{es}G_{ks}G_k$ | 26 | 2834 |
| 1198764 | N/A | N/A | 94735 | 94750 | AGATTTAGGATGCATG | $A_{ks}G_{es}A_{ks}T_{ds}T_{ds}T_{ds}A_{ds}G_{ds}G_{ds}A_{ds}T_{ds}G_{ds}{}^mC_{es}A_{es}T_{ks}G_k$ | 28 | 2835 |
| 1198765 | N/A | N/A | 94736 | 94751 | CAGATTTAGGATGCAT | ${}^mC_{ks}A_{es}A_{ks}A_{ds}T_{ds}T_{ds}T_{ds}A_{ds}G_{ds}G_{ds}A_{ds}T_{ds}G_{es}{}^mC_{es}A_{ks}T_k$ | 23 | 2836 |
| 1198766 | N/A | N/A | 94737 | 94752 | TCAGATTTAGGATGCA | $T_{ks}{}^mC_{es}A_{ks}G_{ds}A_{ds}T_{ds}T_{ds}T_{ds}A_{ds}G_{ds}G_{ds}A_{ds}T_{es}G_{es}{}^mC_{ks}A_k$ | 19 | 2837 |
| 1198767 | N/A | N/A | 94739 | 94754 | ATTCAGATTTAGGATG | $A_{ks}T_{es}T_{ks}{}^mC_{ds}A_{ds}G_{ds}A_{ds}T_{ds}T_{ds}T_{ds}A_{ds}G_{ds}G_{es}A_{es}T_{ks}G_k$ | 65 | 2838 |
| 1198777 | N/A | N/A | 117325 | 117340 | ATTGCAATCTGTCTGA | $A_{ks}T_{es}T_{ks}G_{ds}{}^mC_{ds}A_{ds}A_{ds}T_{ds}{}^mC_{ds}T_{ds}G_{ds}T_{ds}{}^mC_{es}T_{es}G_{ks}A_k$ | 84 | 2843 |
| 1198778 | N/A | N/A | 117327 | 117342 | ATATTGCAATCTGTCT | $A_{ks}T_{es}A_{ks}T_{ds}T_{ds}G_{ds}{}^mC_{ds}A_{ds}A_{ds}T_{ds}{}^mC_{ds}T_{ds}G_{es}T_{es}{}^mC_{ks}T_k$ | 55 | 2844 |
| 1198779 | N/A | N/A | 117328 | 117343 | AATATTGCAATCTGTC | $A_{ks}A_{es}T_{ks}A_{ds}T_{ds}T_{ds}G_{ds}{}^mC_{ds}A_{ds}A_{ds}T_{ds}{}^mC_{ds}T_{es}G_{es}T_{ks}{}^mC_k$ | 49 | 2845 |
| 1198780 | N/A | N/A | 117329 | 117344 | TAATATTGCAATCTGT | $T_{ks}A_{es}A_{ks}T_{ds}A_{ds}T_{ds}T_{ds}G_{ds}{}^mC_{ds}A_{ds}A_{ds}T_{ds}{}^mC_{es}T_{es}G_{ks}T_k$ | 80 | 2846 |
| 1198781 | N/A | N/A | 117330 | 117345 | GTAATATTGCAATCTG | $G_{ks}T_{es}A_{ks}A_{ds}T_{ds}A_{ds}T_{ds}T_{ds}G_{ds}{}^mC_{ds}A_{ds}A_{ds}T_{es}{}^mC_{es}T_{ks}G_k$ | 25 | 1404 |
| 1198782 | N/A | N/A | 117331 | 117346 | TGTAATATTGCAATCT | $T_{ks}G_{es}T_{ks}A_{ds}A_{ds}T_{ds}A_{ds}T_{ds}T_{ds}G_{ds}{}^mC_{ds}A_{ds}A_{es}T_{es}{}^mC_{ks}T_k$ | 61 | 2847 |
| 1198783 | N/A | N/A | 117332 | 117347 | ATGTAATATTGCAATC | $A_{ks}T_{es}G_{ks}T_{ds}A_{ds}A_{ds}T_{ds}A_{ds}T_{ds}T_{ds}G_{ds}{}^mC_{ds}A_{es}A_{es}T_{ks}{}^mC_k$ | 78 | 2848 |
| 1198784 | N/A | N/A | 117333 | 117348 | TATGTAATATTGCAAT | $T_{ks}A_{es}T_{ks}G_{ds}T_{ds}A_{ds}A_{ds}T_{ds}A_{ds}T_{ds}T_{ds}G_{ds}{}^mC_{es}A_{es}A_{ks}T_k$ | 94 | 2849 |
| 1198785 | N/A | N/A | 117335 | 117350 | TTTATGTAATATTGCA | $T_{ks}T_{es}T_{ks}A_{ds}T_{ds}G_{ds}T_{ds}A_{ds}A_{ds}T_{ds}A_{ds}T_{ds}T_{es}G_{es}{}^mC_{ks}A_k$ | 86 | 2850 |
| 1198795 | N/A | N/A | 119667 | 119682 | TAAGGTTTCCCAGATT | $T_{ks}A_{es}A_{ks}G_{ds}G_{ds}T_{ds}T_{ds}T_{ds}{}^mC_{ds}{}^mC_{ds}{}^mC_{ds}A_{ds}G_{es}A_{es}T_{ks}T_k$ | 43 | 2851 |
| 1198796 | N/A | N/A | 119669 | 119684 | AGTAAGGTTTCCCAGA | $A_{ks}G_{es}T_{ks}A_{ds}A_{ds}G_{ds}G_{ds}T_{ds}T_{ds}T_{ds}{}^mC_{ds}{}^mC_{ds}{}^mC_{es}A_{es}G_{ks}A_k$ | 32 | 2852 |
| 1198797 | N/A | N/A | 119670 | 119685 | AAGTAAGGTTTCCCAG | $A_{ks}A_{es}G_{ks}T_{ds}A_{ds}A_{ds}G_{ds}G_{ds}T_{ds}T_{ds}T_{ds}{}^mC_{ds}{}^mC_{es}{}^mC_{es}A_{ks}G_k$ | 31 | 2853 |
| 1198798 | N/A | N/A | 119671 | 119686 | TAAGTAAGGTTTCCCA | $T_{ks}A_{es}A_{ks}G_{ds}T_{ds}A_{ds}A_{ds}G_{ds}G_{ds}T_{ds}T_{ds}T_{ds}{}^mC_{es}{}^mC_{es}{}^mC_{ks}A_k$ | 38 | 2854 |
| 1198799 | N/A | N/A | 119672 | 119687 | CTAAGTAAGGTTTCCC | ${}^mC_{ks}T_{es}A_{ks}A_{ds}G_{ds}T_{ds}A_{ds}A_{ds}G_{ds}G_{ds}T_{ds}T_{ds}T_{es}{}^mC_{es}{}^mC_{ks}{}^mC_k$ | 18 | 1101 |
| 1198800 | N/A | N/A | 119673 | 119688 | ACTAAGTAAGGTTTCC | $A_{ks}{}^mC_{es}T_{ks}A_{ds}A_{ds}G_{ds}T_{ds}A_{ds}A_{ds}G_{ds}G_{ds}T_{ds}T_{es}T_{es}{}^mC_{ks}{}^mC_k$ | 47 | 2855 |
| 1198801 | N/A | N/A | 119674 | 119689 | GACTAAGTAAGGTTTC | $G_{ks}A_{es}{}^mC_{ks}T_{ds}A_{ds}A_{ds}G_{ds}T_{ds}A_{ds}A_{ds}G_{ds}G_{ds}T_{es}T_{es}T_{ks}{}^mC_k$ | 47 | 2856 |
| 1198802 | N/A | N/A | 119675 | 119690 | AGACTAAGTAAGGTTT | $A_{ks}G_{es}A_{ks}{}^mC_{ds}T_{ds}A_{ds}A_{ds}G_{ds}T_{ds}A_{ds}A_{ds}G_{ds}G_{es}T_{es}T_{ks}T_k$ | 83 | 2857 |
| 1198803 | N/A | N/A | 119677 | 119692 | TTAGACTAAGTAAGGT | $T_{ks}T_{es}A_{ks}G_{ds}A_{ds}{}^mC_{ds}T_{ds}A_{ds}A_{ds}G_{ds}T_{ds}A_{ds}A_{es}G_{es}G_{ks}T_k$ | 62 | 2858 |

TABLE 41

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 28 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 14 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 12 | 2800 |
| 1198628 | 2524 | 2539 | 123549 | 123564 | TGTCTCATGCCTTATA | $T_{ks}G_{ds}{}^mC_{ds}{}^mC_{ds}T_{ds}T_{ds}A_{es}T_{ks}A_e$ | 27 | 2803 |
| 1198629 | 2526 | 2541 | 123551 | 123566 | ATTGTCTCATGCCTTA | $A_{ks}T_{ks}T_{ds}G_{ds}T_{ds}{}^mC_{ds}T_{ds}{}^mC_{ds}A_{ds}T_{ds}G_{ds}{}^mC_{ks}{}^mC_{ks}T_{ks}A_e$ | 22 | 2804 |
| 1198630 | 2527 | 2542 | 123552 | 123567 | AATTGTCTCATGCCTT | $A_{ks}A_{ks}T_{ds}T_{ds}G_{ds}T_{ds}{}^mC_{ds}T_{ds}{}^mC_{ds}A_{ds}T_{ds}G_{ds}{}^mC_{ks}{}^mC_{es}T_{ks}T_e$ | 37 | 2805 |

TABLE 41-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198631 | 2528 | 2543 | 123553 | 123568 | AAATTGTCTCATGCCT | $A_{ks}A_{ds}A_{ds}T_{ds}T_{ds}G_{ds}T_{ds}{}^mC_{ds}T_{ds}{}^mC_{ds}A_{ds}T_{ds}G_{ks}{}^mC_{es}{}^mC_{ks}T_e$ | 53 | 443 |
| 1198632 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{ds}T_{ks}G_{es}{}^mC_{ks}{}^mC_e$ | 21 | 2800 |
| 1198633 | 2530 | 2545 | 123555 | 123570 | GGAAATTGTCTCATGC | $G_{ks}G_{ds}A_{ds}A_{ds}A_{ds}T_{ds}T_{ds}G_{ds}T_{ds}{}^mC_{ds}T_{ds}{}^mC_{ds}A_{ds}T_{es}G_{ks}{}^mC_e$ | 46 | 2806 |
| 1198634 | 2531 | 2546 | 123556 | 123571 | TGGAAATTGTCTCATG | $T_{ks}G_{ds}G_{ds}A_{ds}A_{ds}A_{ds}T_{ds}T_{ds}G_{ds}T_{ds}{}^mC_{ds}T_{ds}{}^mC_{ds}{}^mC_{ks}A_{es}T_{ks}G_e$ | 34 | 2807 |
| 1198635 | 2532 | 2547 | 123557 | 123572 | ATGGAAATTGTCTCAT | $A_{ks}T_{ds}G_{ds}G_{ds}A_{ds}A_{ds}A_{ds}T_{ds}T_{ds}G_{ds}T_{ds}{}^mC_{ds}T_{ks}{}^mC_{es}A_{ks}T_e$ | 57 | 2808 |
| 1198636 | 2534 | 2549 | 123559 | 123574 | ATATGGAAATTGTCTC | $A_{ks}T_{ks}A_{ds}T_{ds}G_{ds}G_{ds}A_{ds}A_{ds}A_{ds}T_{ds}T_{ds}G_{ds}T_{ks}{}^mC_{es}T_{ks}{}^mC_e$ | 41 | 656 |
| 1198637 | 2560 | 2575 | 123585 | 123600 | AGTATGTGGCAATAAT | $A_{ks}G_{ks}T_{ds}A_{ds}T_{ds}G_{ds}T_{ds}G_{ds}G_{ds}{}^mC_{ds}A_{ds}A_{ds}T_{ks}A_{es}A_{ks}T_e$ | 64 | 2809 |
| 1198638 | 2562 | 2577 | 123587 | 123602 | AGAGTATGTGGCAATA | $A_{ks}G_{ks}A_{ds}G_{ds}T_{ds}A_{ds}T_{ds}G_{ds}T_{ds}G_{ds}{}^mC_{ds}A_{ds}A_{es}T_{ks}A_e$ | 18 | 2810 |
| 1198639 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}G_{ds}{}^mC_{ds}A_{es}A_{ks}T_e$ | 32 | 2811 |
| 1198640 | 2564 | 2579 | 123589 | 123604 | TTAGAGTATGTGGCAA | $T_{ks}T_{ks}A_{ds}G_{ds}A_{ds}G_{ds}T_{ds}A_{ds}T_{ds}G_{ds}T_{ds}G_{ds}G_{ks}{}^mC_{es}A_{ks}A_e$ | 26 | 963 |
| 1198641 | 2565 | 2580 | 123590 | 123605 | ATTAGAGTATGTGGCA | $A_{ks}T_{ks}T_{ds}A_{ds}G_{ds}A_{ds}G_{ds}T_{ds}A_{ds}T_{ds}G_{ds}T_{ds}G_{ks}G_{es}{}^mC_{ks}A_e$ | 15 | 810 |
| 1198642 | 2566 | 2581 | 123591 | 123606 | TATTAGAGTATGTGGC | $T_{ks}A_{ks}T_{ds}T_{ds}A_{ds}G_{ds}A_{ds}G_{ds}T_{ds}A_{ds}T_{ds}G_{ds}T_{ks}G_{es}G_{ks}{}^mC_e$ | 19 | 2812 |
| 1198643 | 2567 | 2582 | 123592 | 123607 | ATATTAGAGTATGTGG | $A_{ks}T_{ks}A_{ds}T_{ds}T_{ds}A_{ds}G_{ds}A_{ds}G_{ds}T_{ds}A_{ds}T_{ds}G_{ks}T_{es}G_{ks}G_e$ | 25 | 2813 |
| 1198644 | 2568 | 2583 | 123593 | 123608 | TATATTAGAGTATGTG | $T_{ks}A_{ks}T_{ds}A_{ds}T_{ds}T_{ds}A_{ds}G_{ds}A_{ds}G_{ds}T_{ds}A_{ds}T_{ks}G_{es}T_{ks}G_e$ | 73 | 2814 |
| 1198645 | 2570 | 2585 | 123595 | 123610 | TCTATATTAGAGTATG | $T_{ks}{}^mC_{ks}T_{ds}A_{ds}T_{ds}A_{ds}T_{ds}T_{ds}A_{ds}G_{ds}A_{ds}G_{ds}T_{ks}A_{es}T_{ks}G_e$ | 73 | 887 |
| 1198651 | 4595 | 4610 | 125620 | 125635 | TTACATTAGGAACAAG | $T_{ks}T_{ks}A_{ds}{}^mC_{ds}A_{ds}T_{ds}T_{ds}A_{ds}G_{ds}G_{ds}A_{ds}A_{ds}{}^mC_{ks}A_{es}A_{ks}G_e$ | 94 | 2817 |
| 1198652 | 4597 | 4612 | 125622 | 125637 | TTTTACATTAGGAACA | $T_{ks}T_{ks}T_{ds}T_{ds}A_{ds}{}^mC_{ds}A_{ds}T_{ds}T_{ds}A_{ds}G_{ds}G_{ds}A_{ks}A_{es}{}^mC_{ks}A_e$ | 68 | 2818 |
| 1198653 | 4598 | 4613 | 125623 | 125638 | CTTTTACATTAGGAAC | ${}^mC_{ks}T_{ks}T_{ds}T_{ds}T_{ds}A_{ds}{}^mC_{ds}A_{ds}T_{ds}T_{ds}A_{ds}G_{ds}G_{ks}A_{es}A_{ks}{}^mC_e$ | 64 | 1124 |
| 1198654 | 4599 | 4614 | 125624 | 125639 | ACTTTTACATTAGGAA | $A_{ks}{}^mC_{ks}T_{ds}T_{ds}T_{ds}T_{ds}A_{ds}{}^mC_{ds}A_{ds}T_{ds}T_{ds}A_{ds}G_{ks}G_{es}A_{ks}A_e$ | 91 | 2819 |
| 1198655 | 4600 | 4615 | 125625 | 125640 | CACTTTTACATTAGGA | ${}^mC_{ks}A_{ks}{}^mC_{ds}T_{ds}T_{ds}T_{ds}T_{ds}A_{ds}{}^mC_{ds}A_{ds}T_{ds}T_{ds}A_{ks}G_{es}G_{ks}A_e$ | 30 | 1200 |
| 1198656 | 4601 | 4616 | 125626 | 125641 | GCACTTTTACATTAGG | $G_{ks}{}^mC_{ks}A_{ds}{}^mC_{ds}T_{ds}T_{ds}T_{ds}T_{ds}A_{ds}{}^mC_{ds}A_{ds}T_{ds}T_{ks}A_{es}G_{ks}G_e$ | 11 | 1276 |
| 1198657 | 4602 | 4617 | 125627 | 125642 | AGCACTTTTACATTAG | $A_{ks}G_{ks}{}^mC_{ds}A_{ds}{}^mC_{ds}T_{ds}T_{ds}T_{ds}T_{ds}A_{ds}{}^mC_{ds}A_{ds}T_{ks}T_{es}A_{ks}G_e$ | 95 | 2820 |
| 1198658 | 4603 | 4618 | 125628 | 125643 | AAGCACTTTTACATTA | $A_{ks}A_{ks}G_{ds}{}^mC_{ds}A_{ds}{}^mC_{ds}T_{ds}T_{ds}T_{ds}T_{ds}A_{ds}{}^mC_{ds}A_{ks}T_{es}T_{ks}A_e$ | 62 | 2821 |
| 1198659 | 4605 | 4620 | 125630 | 125645 | TTAAGCACTTTTACAT | $T_{ks}T_{ks}A_{ds}A_{ds}G_{ds}{}^mC_{ds}A_{ds}{}^mC_{ds}T_{ds}T_{ds}T_{ds}T_{ds}A_{ks}{}^mC_{es}A_{ks}T_e$ | 58 | 2822 |
| 1198660 | 4795 | 4810 | 125820 | 125835 | GGAAGATCTGAAACTC | $G_{ks}G_{ks}A_{ds}A_{ds}G_{ds}A_{ds}T_{ds}{}^mC_{ds}T_{ds}G_{ds}A_{ds}A_{ds}A_{ks}{}^mC_{es}T_{ks}{}^mC_e$ | 66 | 2823 |
| 1198661 | 4797 | 4812 | 125822 | 125837 | TTGGAAGATCTGAAAC | $T_{ks}T_{ks}G_{ds}G_{ds}A_{ds}A_{ds}G_{ds}A_{ds}T_{ds}{}^mC_{ds}T_{ds}G_{ds}A_{ks}A_{es}A_{ks}{}^mC_e$ | 111 | 2824 |
| 1198662 | 4798 | 4813 | 125823 | 125838 | TTTGGAAGATCTGAAA | $T_{ks}T_{ks}T_{ds}G_{ds}G_{ds}A_{ds}A_{ds}G_{ds}A_{ds}T_{ds}{}^mC_{ds}T_{ds}G_{ks}A_{es}A_{ks}A_e$ | 83 | 2825 |
| 1198663 | 4799 | 4814 | 125824 | 125839 | CTTTGGAAGATCTGAA | ${}^mC_{ks}T_{ks}T_{ds}T_{ds}G_{ds}G_{ds}A_{ds}A_{ds}G_{ds}A_{ds}T_{ds}{}^mC_{ds}T_{ks}G_{es}A_{ks}A_e$ | 76 | 2826 |
| 1198664 | 4800 | 4815 | 125825 | 125840 | GCTTTGGAAGATCTGA | $G_{ks}{}^mC_{ks}T_{ds}T_{ds}T_{ds}G_{ds}G_{ds}A_{ds}A_{ds}G_{ds}A_{ds}T_{ds}{}^mC_{ks}T_{es}G_{ks}A_e$ | 18 | 2044 |
| 1198665 | 4801 | 4816 | 125826 | 125841 | TGCTTTGGAAGATCTG | $T_{ks}G_{ks}{}^mC_{ds}T_{ds}T_{ds}T_{ds}G_{ds}G_{ds}A_{ds}A_{ds}G_{ds}A_{ds}T_{ks}{}^mC_{es}T_{ks}G_e$ | 38 | 2121 |
| 1198666 | 4802 | 4817 | 125827 | 125842 | GTGCTTTGGAAGATCT | $G_{ks}T_{ks}G_{ds}{}^mC_{ds}T_{ds}T_{ds}T_{ds}G_{ds}{}_sG_{ds}A_{ds}A_{ds}G_{ds}A_{ks}T_{es}{}^mC_{ks}T_e$ | 44 | 2827 |
| 1198667 | 4803 | 4818 | 125828 | 125843 | AGTGCTTTGGAAGATC | $A_{ks}G_{ks}T_{ds}G_{ds}{}^mC_{ds}T_{ds}T_{ds}T_{ds}G_{ds}G_{ds}A_{ds}A_{ds}G_{ks}A_{es}T_{ks}{}^mC_e$ | 40 | 2828 |
| 1198668 | 4805 | 4820 | 125830 | 125845 | ATAGTGCTTTGGAAGA | $A_{ks}T_{ks}A_{ds}G_{ds}T_{ds}G_{ds}{}^mC_{ds}T_{ds}T_{ds}T_{ds}G_{ds}G_{ds}A_{ks}A_{es}G_{ks}A_e$ | 72 | 2829 |
| 1198669 | N/A | N/A | 94729 | 94744 | AGGATGCATGGTTTTT | $A_{ks}G_{ks}G_{ds}A_{ds}T_{ds}G_{ds}{}^mC_{ds}A_{ds}T_{ds}G_{ds}G_{ds}T_{ds}T_{ks}T_{es}T_{ks}T_e$ | 61 | 2830 |
| 1198670 | N/A | N/A | 94731 | 94746 | TTAGGATGCATGGTTT | $T_{ks}T_{ks}A_{ds}G_{ds}G_{ds}A_{ds}T_{ds}G_{ds}{}^mC_{ds}A_{ds}T_{ds}G_{ds}G_{ks}T_{es}T_{ks}T_e$ | 55 | 2831 |
| 1198671 | N/A | N/A | 94732 | 94747 | TTTAGGATGCATGGTT | $T_{ks}T_{ks}T_{ds}A_{ds}G_{ds}G_{ds}A_{ds}T_{ds}G_{ds}{}^mC_{ds}A_{ds}T_{ds}G_{ks}G_{es}T_{ks}T_e$ | 26 | 2832 |

TABLE 41-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198672 | N/A | N/A | 94733 | 94748 | ATTTAGGATGCATGGT | $A_{ks}T_{ks}T_{ds}T_{ds}A_{ds}G_{ds}G_{ds}A_{ds}T_{ds}G_{ds}{}^mC_{ds}A_{ds}T_{ks}G_{es}G_{ks}T_e$ | 41 | 2833 |
| 1198673 | N/A | N/A | 94734 | 94749 | GATTTAGGATGCATGG | $G_{ks}A_{ks}T_{ds}T_{ds}T_{ds}A_{ds}G_{ds}G_{ds}A_{ds}T_{ds}G_{ds}{}^mC_{ds}A_{ks}T_{es}G_{ks}G_e$ | 10 | 2834 |
| 1198674 | N/A | N/A | 94735 | 94750 | AGATTTAGGATGCATG | $A_{ks}G_{ks}A_{ds}T_{ds}T_{ds}T_{ds}A_{ds}G_{ds}G_{ds}A_{ds}T_{ds}G_{ds}{}^mC_{ks}A_{es}T_{ks}G_e$ | 21 | 2835 |
| 1198675 | N/A | N/A | 94736 | 94751 | CAGATTTAGGATGCAT | $^mC_{ks}A_{ks}G_{ds}A_{ds}T_{ds}T_{ds}T_{ds}A_{ds}G_{ds}G_{ds}A_{ds}T_{ds}G_{ks}{}^mC_{es}A_{ks}T_e$ | 35 | 2836 |
| 1198676 | N/A | N/A | 94737 | 94752 | TCAGATTTAGGATGCA | $T_{ks}{}^mC_{ks}A_{ds}G_{ds}A_{ds}T_{ds}T_{ds}T_{ds}A_{ds}G_{ds}G_{ds}A_{ds}T_{ks}G_{es}{}^mC_{ks}A_e$ | 52 | 2837 |
| 1198677 | N/A | N/A | 94739 | 94754 | ATTCAGATTTAGGATG | $A_{ks}T_{ks}T_{ds}{}^mC_{ds}A_{ds}G_{ds}A_{ds}T_{ds}T_{ds}T_{ds}A_{ds}G_{ds}G_{ks}A_{es}T_{ks}G_e$ | 87 | 2838 |
| 1198687 | N/A | N/A | 117325 | 117340 | ATTGCAATCTGTCTGA | $A_{ks}T_{ks}T_{ds}G_{ds}{}^mC_{ds}A_{ds}A_{ds}T_{ds}{}^mC_{ds}T_{ds}G_{ds}T_{ds}{}^mC_{ks}T_{es}G_{ks}A_e$ | 55 | 2843 |
| 1198688 | N/A | N/A | 117327 | 117342 | ATATTGCAATCTGTCT | $A_{ks}T_{ks}A_{ds}T_{ds}T_{ds}G_{ds}{}^mC_{ds}A_{ds}A_{ds}T_{ds}{}^mC_{ds}T_{ds}G_{ks}T_{es}{}^mC_{ks}T_e$ | 48 | 2844 |
| 1198689 | N/A | N/A | 117328 | 117343 | AATATTGCAATCTGTC | $A_{ks}A_{ks}T_{ds}A_{ds}T_{ds}T_{ds}G_{ds}{}^mC_{ds}A_{ds}A_{ds}T_{ds}{}^mC_{ds}T_{ks}G_{es}T_{ks}{}^mC_e$ | 91 | 2845 |
| 1198690 | N/A | N/A | 117329 | 117344 | TAATATTGCAATCTGT | $T_{ks}A_{ks}A_{ds}T_{ds}A_{ds}T_{ds}T_{ds}G_{ds}{}^mC_{ds}A_{ds}A_{ds}T_{ds}{}^mC_{ks}T_{es}G_{ks}T_e$ | 64 | 2846 |
| 1198691 | N/A | N/A | 117330 | 117345 | GTAATATTGCAATCTG | $G_{ks}T_{ks}A_{ds}A_{ds}T_{ds}A_{ds}T_{ds}T_{ds}G_{ds}{}^mC_{ds}A_{ds}A_{ds}T_{ks}{}^mC_{es}T_{ks}G_e$ | 38 | 1404 |
| 1198692 | N/A | N/A | 117331 | 117346 | TGTAATATTGCAATCT | $T_{ks}G_{ks}T_{ds}A_{ds}A_{ds}T_{ds}A_{ds}T_{ds}T_{ds}G_{ds}{}^mC_{ds}A_{ds}A_{ks}T_{es}{}^mC_{ks}T_e$ | 120 | 2847 |
| 1198733 | 4438 | 4453 | 125463 | 125478 | GGTATAACTGGGCAAA | $G_{ks}G_{es}T_{ks}A_{ds}T_{ds}A_{ds}A_{ds}{}^mC_{ds}T_{ds}G_{ds}G_{ds}G_{ds}{}^mC_{es}A_{es}A_{ks}A_k$ | 47 | 1427 |
| 1198734 | 4439 | 4454 | 125464 | 125479 | AGGTATAACTGGGCAA | $A_{ks}G_{es}G_{ks}T_{ds}A_{ds}T_{ds}A_{ds}A_{ds}{}^mC_{ds}T_{ds}G_{ds}G_{ds}G_{es}{}^mC_{es}A_{ks}A_k$ | 29 | 905 |
| 1198735 | 4440 | 4455 | 125465 | 125480 | GAGGTATAACTGGGCA | $G_{ks}A_{es}G_{ks}G_{ds}T_{ds}A_{ds}T_{ds}A_{ds}A_{ds}{}^mC_{ds}T_{ds}G_{ds}G_{es}G_{es}{}^mC_{ks}A_k$ | 34 | 1503 |
| 1198736 | 4441 | 4456 | 125466 | 125481 | TGAGGTATAACTGGGC | $T_{ks}G_{es}A_{ks}G_{ds}G_{ds}T_{ds}A_{ds}T_{ds}A_{ds}A_{ds}{}^mC_{ds}T_{ds}G_{es}G_{es}G_{ks}{}^mC_k$ | 20 | 1580 |
| 1198737 | 4442 | 4457 | 125467 | 125482 | CTGAGGTATAACTGGG | $^mC_{ks}T_{es}G_{ks}A_{ds}G_{ds}G_{ds}T_{ds}A_{ds}T_{ds}A_{ds}A_{ds}{}^mC_{ds}T_{es}G_{es}G_{ks}G_k$ | 24 | 2801 |
| 1198738 | 4443 | 4458 | 125468 | 125483 | ACTGAGGTATAACTGG | $A_{ks}{}^mC_{es}T_{ks}G_{ds}A_{ds}G_{ds}G_{ds}T_{ds}A_{ds}T_{ds}A_{ds}A_{ds}{}^mC_{es}T_{es}G_{ks}G_k$ | 38 | 392 |
| 1198739 | 4444 | 4459 | 125469 | 125484 | CACTGAGGTATAACTG | $^mC_{ks}A_{es}{}^mC_{ks}T_{ds}G_{ds}A_{ds}G_{ds}G_{ds}T_{ds}A_{ds}T_{ds}A_{ds}A_{es}{}^mC_{es}T_{ks}G_k$ | 94 | 2802 |
| 1198740 | 4446 | 4461 | 125471 | 125486 | AACACTGAGGTATAAC | $A_{ks}Am C_{ks}A_{ds}{}^mC_{ds}T_{ds}G_{ds}A_{ds}G_{ds}G_{ds}T_{ds}A_{ds}T_{es}A_{es}A_{ks}{}^mC_k$ | 39 | 2816 |
| 1198768 | N/A | N/A | 115903 | 115918 | ATATGGTTTTGTGTGT | $A_{ks}T_{es}A_{ks}T_{ds}G_{ds}G_{ds}T_{ds}T_{ds}T_{ds}T_{ds}G_{ds}T_{ds}G_{es}T_{es}G_{ks}T_k$ | 61 | 2839 |
| 1198769 | N/A | N/A | 115905 | 115920 | TTATATGGTTTTGTGT | $T_{ks}T_{es}A_{ks}T_{ds}A_{ds}T_{ds}G_{ds}G_{ds}T_{ds}T_{ds}T_{ds}T_{ds}G_{es}T_{es}G_{ks}T_k$ | 77 | 2840 |
| 1198770 | N/A | N/A | 115906 | 115921 | CTTATATGGTTTTGTG | $^mC_{ks}T_{es}T_{ks}A_{ds}T_{ds}A_{ds}T_{ds}G_{ds}G_{ds}T_{ds}T_{ds}T_{ds}T_{es}T_{es}G_{ks}G_k$ | 40 | 2788 |
| 1198771 | N/A | N/A | 115907 | 115922 | TCTTATATGGTTTTGT | $T_{ks}{}^mC_{es}T_{ks}T_{ds}A_{ds}T_{ds}A_{ds}T_{ds}G_{ds}G_{ds}T_{ds}T_{ds}T_{es}T_{es}G_{ks}T_k$ | 85 | 2841 |
| 1198772 | N/A | N/A | 115908 | 115923 | CTCTTATATGGTTTTG | $^mC_{ks}T_{es}{}^mC_{ks}T_{ds}T_{ds}A_{ds}T_{ds}A_{ds}T_{ds}G_{ds}G_{ds}T_{ds}T_{es}T_{es}T_{ks}G_k$ | 41 | 2842 |
| 1198773 | N/A | N/A | 115909 | 115924 | ACTCTTATATGGTTTT | $A_{ks}{}^mC_{es}T_{ks}{}^mC_{ds}T_{ds}T_{ds}A_{ds}T_{ds}A_{ds}T_{ds}G_{ds}G_{ds}T_{es}T_{es}T_{ks}T_k$ | 58 | 2859 |
| 1198774 | N/A | N/A | 115910 | 115925 | AACTCTTATATGGTTT | $A_{ks}A_{es}{}^mC_{ks}T_{ds}{}^mC_{ds}T_{ds}T_{ds}A_{ds}T_{ds}A_{ds}T_{ds}G_{ds}G_{es}T_{es}T_{ks}T_k$ | 106 | 2860 |
| 1198775 | N/A | N/A | 115911 | 115926 | CAACTCTTATATGGTT | $^mC_{ks}A_{es}A_{ks}{}^mC_{ds}T_{ds}{}^mC_{ds}T_{ds}T_{ds}A_{ds}T_{ds}A_{ds}T_{ds}G_{es}G_{es}T_{ks}T_k$ | 113 | 2861 |
| 1198776 | N/A | N/A | 115913 | 115928 | GACAACTCTTATATGG | $G_{ks}A_{es}{}^{m+1C}{}_{ks}A_{ds}A_{ds}{}^mC_{ds}T_{ds}{}^mC_{ds}T_{ds}T_{ds}A_{ds}T_{ds}A_{es}T_{es}G_{ks}G_k$ | 57 | 2862 |
| 1198786 | N/A | N/A | 117755 | 117770 | TGTATGTCAGAAGAGT | $T_{ks}G_{es}T_{ks}A_{ds}T_{ds}G_{ds}T_{ds}{}^mC_{ds}A_{dshu}{}^mC_{ds}A_{ds}G_{ds}A_{ds}A_{ds}G_{es}T_k$ | 16 | 2863 |
| 1198787 | N/A | N/A | 117757 | 117772 | AGTGTATGTCAGAAGA | $A_{ks}G_{es}T_{ks}G_{ds}T_{ds}A_{ds}T_{ds}G_{ds}T_{ds}{}^mC_{ds}A_{ds}G_{ds}A_{es}A_{es}G_{ks}A_k$ | 9 | 2864 |
| 1198788 | N/A | N/A | 117758 | 117773 | AAGTGTATGTCAGAAG | $A_{ks}A_{es}G_{ks}T_{ds}G_{ds}T_{ds}A_{ds}T_{ds}G_{ds}T_{ds}{}^mC_{ds}A_{ds}G_{es}A_{es}A_{ks}G_k$ | 17 | 2865 |
| 1198789 | N/A | N/A | 117759 | 117774 | AAAGTGTATGTCAGAA | $A_{ks}A_{es}A_{ks}G_{ds}T_{ds}G_{ds}T_{ds}A_{ds}T_{ds}G_{ds}T_{ds}{}^mC_{ds}A_{es}G_{es}A_{ks}A_k$ | 22 | 2866 |
| 1198790 | N/A | N/A | 117760 | 117775 | TAAAGTGTATGTCAGA | $T_{ks}A_{es}A_{ks}A_{ds}G_{ds}T_{ds}G_{ds}T_{ds}A_{ds}T_{ds}G_{ds}T_{ds}{}^mC_{es}A_{es}G_{ks}A_k$ | 27 | 2867 |
| 1198791 | N/A | N/A | 117761 | 117776 | TTAAAGTGTATGTCAG | $T_{ks}A_{es}A_{ks}A_{ds}A_{ds}G_{ds}T_{ds}G_{ds}T_{ds}A_{ds}T_{ds}G_{ds}T_{es}{}^mC_{es}A_{ks}G_k$ | 39 | 2868 |
| 1198792 | N/A | N/A | 117762 | 117777 | TTTAAAGTGTATGTCA | $T_{ks}T_{es}T_{ks}A_{ds}A_{ds}A_{ds}G_{ds}T_{ds}G_{ds}T_{ds}A_{ds}T_{ds}G_{es}T_{es}{}^mC_{ks}A_k$ | 48 | 2869 |

TABLE 41-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198793 | N/A | N/A | 117763 | 117778 | CTTTAAAGTGTATGTC | $^mC_{ks}T_{es}T_{ks}T_{ds}A_{ds}A_{ds}A_{ds}G_{ds}T_{ds}G_{ds}T_{ds}A_{ds}T_{es}G_{es}T_{ks}{}^mC_k$ | 34 | 1634 |
| 1198794 | N/A | N/A | 117765 | 117780 | AACTTTAAAGTGTATG | $A_{ks}A_{es}{}^mC_{ks}T_{ds}T_{ds}T_{ds}A_{ds}A_{ds}A_{ds}G_{ds}T_{ds}G_{ds}T_{es}A_{es}T_{ks}G_k$ | 74 | 2870 |

TABLE 42

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ds}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 29 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}{}^mC_{ks}A_k$ | 15 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{k}{}^mC_{ks}{}^mC_k$ | 11 | 2800 |
| 1095463 | 4443 | 4458 | 125468 | 125483 | ACTGAGGTATAACTGG | $A_{ks}{}^mC_{ks}T_{ds}G_{ds}A_{ds}G_{ds}G_{ds}T_{ds}A_{ds}T_{ds}A_{ds}A_{ds}{}^mC_{ks}T_{es}G_{ks}G_e$ | 37 | 392 |
| 1095481 | 4441 | 4456 | 125466 | 125481 | TGAGGTATAACTGGGC | $T_{ks}G_{ks}A_{ds}G_{ds}G_{ds}T_{ds}A_{ds}T_{ds}A_{ds}A_{ds}{}^mC_{ds}T_{ds}G_{ks}G_{es}G_{k}{}^mC_e$ | 21 | 1580 |
| 1095482 | 4442 | 4457 | 125467 | 125482 | CTGAGGTATAACTGGG | $^mC_{ks}T_{ks}G_{ds}A_{ds}G_{ds}G_{ds}T_{ds}A_{ds}T_{ds}A_{ds}A_{ds}{}^mC_{ds}T_{ks}G_{es}G_{ks}G_e$ | 72 | 2801 |
| 1095483 | 4444 | 4459 | 125469 | 125484 | CACTGAGGTATAACTG | $^mC_{ks}A_{ks}{}^mC_{ds}T_{ds}G_{ds}A_{ds}G_{ds}G_{ds}T_{ds}A_{ds}T_{ds}A_{ds}A_{ks}{}^mC_{es}T_{ks}G_e$ | 101 | 2802 |
| 1198198 | 2524 | 2539 | 123549 | 123564 | TGTCTCATGCCTTATA | $T_{ks}G_{ks}T_{ds}{}^mC_{ds}T_{ds}{}^mC_{ds}A_{ds}T_{ds}G_{ds}{}^mC_{ds}{}^mC_{ds}T_{es}T_{es}A_{es}T_{ks}A_k$ | 29 | 2803 |
| 1198199 | 2526 | 2541 | 123551 | 123566 | ATTGTCTCATGCCTTA | $A_{ks}T_{ks}T_{ds}G_{ds}T_{ds}{}^mC_{ds}T_{ds}{}^mC_{ds}A_{ds}T_{ds}G_{ds}{}^mC_{es}{}^mC_{es}T_{es}T_{ks}A_k$ | 38 | 2804 |
| 1198200 | 2527 | 2542 | 123552 | 123567 | AATTGTCTCATGCCTT | $A_{ks}A_{ks}T_{ds}T_{ds}G_{ds}T_{ds}{}^mC_{ds}T_{ds}{}^mC_{ds}A_{ds}T_{ds}G_{es}{}^mC_{es}{}^mC_{es}T_{ks}T_k$ | 49 | 2805 |
| 1198201 | 2528 | 2543 | 123553 | 123568 | AAATTGTCTCATGCCT | $A_{ks}A_{ks}A_{ds}T_{ds}T_{ds}G_{ds}T_{ds}{}^mC_{ds}T_{ds}{}^mC_{ds}A_{ds}T_{es}G_{es}{}^mC_{es}{}^mC_{ks}T_k$ | 34 | 443 |
| 1198202 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{es}T_{es}G_{es}{}^mC_{ks}{}^mC_k$ | 14 | 2800 |
| 1198203 | 2530 | 2545 | 123555 | 123570 | GGAAATTGTCTCATGC | $G_{ks}G_{ks}A_{ds}A_{ds}A_{ds}T_{ds}T_{ds}G_{ds}T_{ds}{}^mC_{ds}T_{ds}{}^mC_{es}A_{es}T_{es}G_{ks}{}^mC_k$ | 19 | 2806 |
| 1198204 | 2531 | 2546 | 123556 | 123571 | TGGAAATTGTCTCATG | $T_{ks}G_{ks}G_{ds}A_{ds}A_{ds}A_{ds}T_{ds}T_{ds}G_{ds}T_{ds}{}^mC_{ds}T_{es}{}^mC_{es}A_{es}T_{ks}G_k$ | 31 | 2807 |
| 1198205 | 2532 | 2547 | 123557 | 123572 | ATGGAAATTGTCTCAT | $A_{ks}T_{ks}G_{ds}G_{ds}A_{ds}A_{ds}A_{ds}T_{ds}T_{ds}G_{ds}T_{ds}{}^mC_{es}T_{es}{}^mC_{es}A_{ks}T_k$ | 64 | 2808 |
| 1198206 | 2534 | 2549 | 123559 | 123574 | ATATGGAAATTGTCTC | $A_{ks}T_{ks}A_{ds}T_{ds}G_{ds}G_{ds}A_{ds}A_{ds}A_{ds}T_{ds}T_{ds}G_{es}T_{es}{}^mC_{es}T_{ks}{}^mC_k$ | 43 | 656 |
| 1198207 | 2560 | 2575 | 123585 | 123600 | AGTATGTGGCAATAAT | $A_{ks}G_{ks}T_{ds}A_{ds}T_{ds}G_{ds}T_{ds}G_{ds}G_{ds}{}^mC_{ds}A_{ds}A_{es}T_{es}A_{es}A_{ks}T_k$ | 91 | 2809 |
| 1198208 | 2562 | 2577 | 123587 | 123602 | AGAGTATGTGGCAATA | $A_{ks}G_{ks}A_{ds}G_{ds}T_{ds}A_{ds}T_{ds}G_{ds}T_{ds}G_{ds}G_{ds}{}^mC_{es}A_{es}A_{es}T_{ks}A_k$ | 25 | 2810 |
| 1198209 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}G_{es}{}^mC_{es}A_{es}A_{ks}T_k$ | 45 | 2811 |
| 1198210 | 2564 | 2579 | 123589 | 123604 | TTAGAGTATGTGGCAA | $T_{ks}T_{ks}A_{ds}G_{ds}A_{ds}G_{ds}T_{ds}A_{ds}T_{ds}G_{ds}T_{ds}G_{es}G_{es}{}^mC_{es}A_{ks}A_k$ | 28 | 963 |
| 1198211 | 2565 | 2580 | 123590 | 123605 | ATTAGAGTATGTGGCA | $A_{ks}T_{ks}T_{ds}A_{ds}G_{ds}A_{ds}G_{ds}T_{ds}A_{ds}T_{ds}G_{ds}T_{es}G_{es}G_{es}{}^mC_{ks}A_k$ | 19 | 810 |
| 1198212 | 2566 | 2581 | 123591 | 123606 | TATTAGAGTATGTGGC | $T_{ks}A_{ks}T_{ds}T_{ds}A_{ds}G_{ds}A_{ds}G_{ds}T_{ds}A_{ds}T_{ds}G_{es}T_{es}G_{es}G_{ks}{}^mC_k$ | 17 | 2812 |
| 1198213 | 2567 | 2582 | 123592 | 123607 | ATATTAGAGTATGTGG | $A_{ks}T_{ks}A_{ds}T_{ds}T_{ds}A_{ds}G_{ds}A_{ds}G_{ds}T_{ds}A_{ds}T_{es}G_{es}T_{es}G_{ks}G_k$ | 16 | 2813 |
| 1198214 | 2568 | 2583 | 123593 | 123608 | TATATTAGAGTATGTG | $T_{ks}A_{ks}T_{ds}A_{ds}T_{ds}T_{ds}A_{ds}G_{ds}A_{ds}G_{ds}T_{ds}A_{es}T_{es}G_{es}T_{ks}G_k$ | 91 | 2814 |
| 1198215 | 2570 | 2585 | 123595 | 123610 | TCTATATTAGAGTATG | $T_{ks}{}^mC_{ks}T_{ds}A_{ds}T_{ds}A_{ds}T_{ds}T_{ds}A_{ds}G_{ds}A_{ds}G_{es}T_{es}A_{es}T_{ks}G_k$ | 120 | 887 |
| 1198221 | 4595 | 4610 | 125620 | 125635 | TTACATTAGGAACAAG | $T_{ks}T_{ks}A_{ds}{}^mC_{ds}A_{ds}T_{ds}T_{ds}A_{ds}G_{ds}G_{ds}A_{ds}A_{es}{}^mC_{es}A_{es}A_{ks}G_k$ | 95 | 2817 |
| 1198222 | 4597 | 4612 | 125622 | 125637 | TTTTACATTAGGAACA | $T_{ks}T_{ks}T_{ds}T_{ds}A_{ds}{}^mC_{ds}A_{ds}T_{ds}T_{ds}A_{ds}G_{ds}G_{es}A_{es}A_{es}{}^mC_{ks}A_k$ | 87 | 2818 |

TABLE 42-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198223 | 4598 | 4613 | 125623 | 125638 | CTTTTACATTAGGAAC | $^mC_{ks}T_{ks}T_{ds}T_{ds}T_{ds}A_{ds}^mC_{ds}A_{ds}T_{ds}T_{ds}A_{ds}G_{es}A_{es}A_{ks}^mC_k$ | 94 | 1124 |
| 1198224 | 4599 | 4614 | 125624 | 125639 | ACTTTTACATTAGGAA | $A_{ks}^mC_{ks}T_{ds}T_{ds}T_{ds}T_{ds}A_{ds}^mC_{ds}A_{ds}T_{ds}T_{ds}A_{es}G_{es}G_{es}A_{ks}A_k$ | 74 | 2819 |
| 1198225 | 4600 | 4615 | 125625 | 125640 | CACTTTTACATTAGGA | $^mC_{ks}^mC_{ds}T_{ds}T_{ds}T_{ds}T_{ds}A_{ds}^mC_{ds}A_{ds}T_{ds}T_{es}A_{es}G_{es}G_{ks}A_k$ | 67 | 1200 |
| 1198226 | 4601 | 4616 | 125626 | 125641 | GCACTTTTACATTAGG | $G_{ks}^mC_{ks}A_{ds}^mC_{ds}T_{ds}T_{ds}T_{ds}T_{ds}A_{ds}^mC_{ds}A_{ds}T_{es}T_{es}A_{es}G_{ks}G_k$ | 23 | 1276 |
| 1198227 | 4602 | 4617 | 125627 | 125642 | AGCACTTTTACATTAG | $A_{ks}G_{ks}^mC_{ds}A_{ds}^mC_{ds}T_{ds}T_{ds}T_{ds}T_{ds}A_{ds}^mC_{ds}A_{es}T_{es}T_{es}A_{ks}G_k$ | 104 | 2820 |
| 1198228 | 4603 | 4618 | 125628 | 125643 | AAGCACTTTTACATTA | $A_{ks}A_{ks}G_{ds}^mC_{ds}A_{ds}^mC_{ds}T_{ds}T_{ds}T_{ds}T_{ds}A_{ds}^mC_{es}A_{es}T_{es}T_{ks}A_k$ | 54 | 2821 |
| 1198229 | 4605 | 4620 | 125630 | 125645 | TTAAGCACTTTTACAT | $T_{ks}T_{ks}A_{ds}A_{ds}G_{ds}^mC_{ds}A_{ds}^mC_{ds}T_{ds}T_{ds}T_{ds}T_{es}A_{es}^mC_{es}A_{ks}T_k$ | 80 | 2822 |
| 1198230 | 4795 | 4810 | 125820 | 125835 | GGAAGATCTGAAACTC | $G_{ks}G_{ks}A_{ds}A_{ds}G_{ds}A_{ds}T_{ds}^mC_{ds}T_{ds}G_{ds}A_{es}A_{es}^mC_{es}T_{ks}^mC_k$ | 81 | 2823 |
| 1198231 | 4797 | 4812 | 125822 | 125837 | TTGGAAGATCTGAAAC | $T_{ks}T_{ks}G_{ds}G_{ds}A_{ds}A_{ds}G_{ds}A_{ds}T_{ds}^mC_{ds}T_{ds}G_{es}A_{es}A_{ks}^mC_k$ | 73 | 2824 |
| 1198232 | 4798 | 4813 | 125823 | 125838 | TTTGGAAGATCTGAAA | $T_{ks}T_{ks}T_{ds}G_{ds}G_{ds}A_{ds}A_{ds}G_{ds}A_{ds}T_{ds}^mC_{ds}T_{es}G_{es}A_{es}A_{ks}A_k$ | 92 | 2825 |
| 1198233 | 4799 | 4814 | 125824 | 125839 | CTTTGGAAGATCTGAA | $^mC_{ks}T_{ks}T_{ds}T_{ds}G_{ds}G_{ds}A_{ds}A_{ds}G_{ds}A_{ds}T_{ds}^mC_{es}T_{es}G_{es}A_{ks}A_k$ | 49 | 2826 |
| 1198234 | 4800 | 4815 | 125825 | 125840 | GCTTTGGAAGATCTGA | $G_{ks}^mC_{ks}T_{ds}T_{ds}T_{ds}G_{ds}G_{ds}A_{ds}A_{ds}G_{ds}A_{ds}T_{es}^mC_{es}T_{es}G_{ks}A_k$ | 45 | 2044 |
| 1198235 | 4801 | 4816 | 125826 | 125841 | TGCTTTGGAAGATCTG | $T_{ks}G_{ks}^mC_{ds}T_{ds}T_{ds}T_{ds}G_{ds}G_{ds}A_{ds}A_{ds}G_{ds}A_{es}T_{es}^mC_{es}T_{ks}G_k$ | 49 | 2121 |
| 1198236 | 4802 | 4817 | 125827 | 125842 | GTGCTTTGGAAGATCT | $G_{ks}T_{ks}G_{ds}^mC_{ds}T_{ds}T_{ds}T_{ds}G_{ds}G_{ds}A_{ds}A_{ds}G_{es}A_{es}T_{es}^mC_{ks}T_k$ | 24 | 2827 |
| 1198237 | 4803 | 4818 | 125828 | 125843 | AGTGCTTTGGAAGATC | $A_{ks}G_{ks}T_{ds}G_{ds}^mC_{ds}T_{ds}T_{ds}T_{ds}G_{ds}G_{ds}A_{ds}A_{es}G_{es}A_{ks}^mC_k$ | 51 | 2828 |
| 1198238 | 4805 | 4820 | 125830 | 125845 | ATAGTGCTTTGGAAGA | $A_{ks}T_{ks}A_{ds}G_{ds}T_{ds}G_{ds}^mC_{ds}T_{ds}T_{ds}T_{ds}G_{ds}G_{es}A_{es}A_{ks}A_k$ | 88 | 2829 |
| 1198239 | N/A | N/A | 94729 | 94744 | AGGATGCATGGTTTTT | $A_{ks}G_{ks}G_{ds}A_{ds}T_{ds}G_{ds}^mC_{ds}A_{ds}T_{ds}G_{ds}G_{ds}T_{es}T_{es}T_{es}T_{ks}T_k$ | 39 | 2830 |
| 1198240 | N/A | N/A | 94731 | 94746 | TTAGGATGCATGGTTT | $T_{ks}T_{ks}A_{ds}G_{ds}G_{ds}A_{ds}T_{ds}G_{ds}^mC_{ds}A_{ds}T_{ds}G_{es}G_{es}T_{es}T_{ks}T_k$ | 43 | 2831 |
| 1198646 | 4436 | 4451 | 125461 | 125476 | TATAACTGGGCAAATT | $T_{ks}A_{ks}T_{ds}A_{ds}A_{ds}^mC_{ds}T_{ds}G_{ds}G_{ds}G_{ds}^mC_{ds}A_{ds}A_{ks}A_{es}T_{ks}T_e$ | 80 | 2815 |
| 1198647 | 4438 | 4453 | 125463 | 125478 | GGTATAACTGGGCAAA | $G_{ks}G_{ks}T_{ds}A_{ds}T_{ds}A_{ds}A_{ds}^mC_{ds}T_{ds}G_{ds}G_{ds}G_{ds}^mC_{ks}A_{es}A_{ks}A_e$ | 47 | 1427 |
| 1198648 | 4439 | 4454 | 125464 | 125479 | AGGTATAACTGGGCAA | $A_{ks}G_{ks}G_{ds}T_{ds}A_{ds}T_{ds}A_{ds}A_{ds}^mC_{ds}T_{ds}G_{ds}G_{ds}G_{ks}^mC_{es}A_{ks}A_e$ | 43 | 905 |
| 1198649 | 4440 | 4455 | 125465 | 125480 | GAGGTATAACTGGGCA | $G_{ks}A_{ks}G_{ds}G_{ds}T_{ds}A_{ds}T_{ds}A_{ds}A_{ds}^mC_{ds}T_{ds}G_{ds}G_{ks}G_{es}^mC_{ks}A_e$ | 27 | 1503 |
| 1198650 | 4446 | 4461 | 125471 | 125486 | AACACTGAGGTATAAC | $A_{ks}A_{ks}^mC_{ds}A_{ds}^mC_{ds}T_{ds}G_{ds}A_{ds}G_{ds}G_{ds}T_{ds}A_{Tks+Les}A_{ks}^mC_e$ | 88 | 2816 |
| 1198678 | N/A | N/A | 115903 | 115918 | ATATGGTTTTGTGTGT | $A_{ks}T_{ks}A_{ds}T_{ds}G_{ds}G_{ds}T_{ds}T_{ds}T_{ds}T_{ds}G_{ds}T_{ds}G_{ks}T_{es}G_{ks}T_e$ | 58 | 2839 |
| 1198679 | N/A | N/A | 115905 | 115920 | TTATATGGTTTTGTGT | $T_{ks}T_{ks}A_{ds}T_{ds}A_{ds}T_{ds}G_{ds}G_{ds}T_{ds}T_{ds}T_{ds}T_{ds}G_{ks}T_{es}G_{ks}T_e$ | 54 | 2840 |
| 1198680 | N/A | N/A | 115906 | 115921 | CTTATATGGTTTTGTG | $^mC_{ks}T_{ks}T_{ds}A_{ds}T_{ds}A_{ds}T_{ds}G_{ds}G_{ds}T_{ds}T_{ds}T_{ds}T_{ks}G_{es}T_{ks}G_e$ | 28 | 2788 |
| 1198681 | N/A | N/A | 115907 | 115922 | TCTTATATGGTTTTGT | $T_{ks}^mC_{ds}T_{ds}T_{ds}A_{ds}T_{ds}A_{ds}T_{ds}G_{ds}G_{ds}T_{ds}T_{ds}T_{ks}T_{es}G_{ks}T_e$ | 54 | 2841 |
| 1198682 | N/A | N/A | 115908 | 115923 | CTCTTATATGGTTTTG | $^mC_{ks}T_{ks}^mC_{ds}T_{ds}T_{ds}A_{ds}T_{ds}A_{ds}T_{ds}G_{ds}G_{ds}T_{ds}T_{ks}T_{es}T_{ks}G_e$ | 25 | 2842 |
| 1198683 | N/A | N/A | 115909 | 115924 | ACTCTTATATGGTTTT | $A_{ks}^mC_{ks}T_{ds}^mC_{ds}T_{ds}T_{ds}A_{ds}T_{ds}A_{ds}T_{ds}G_{ds}G_{ds}T_{ds}T_{es}T_{ks}T_e$ | 27 | 2859 |
| 1198684 | N/A | N/A | 115910 | 115925 | AACTCTTATATGGTTT | $A_{ks}A_{ks}^mC_{ds}T_{ds}^mC_{ds}T_{ds}T_{ds}A_{ds}T_{ds}A_{ds}T_{ds}G_{ds}G_{ks}T_{es}T_{ks}T_e$ | 75 | 2860 |
| 1198685 | N/A | N/A | 115911 | 115926 | CAACTCTTATATGGTT | $^mC_{ks}A_{ks}A_{ds}^mC_{ds}T_{ds}^mC_{ds}T_{ds}T_{ds}A_{ds}T_{ds}A_{ds}T_{ds}G_{ks}G_{es}T_{ks}T_e$ | 70 | 2861 |
| 1198686 | N/A | N/A | 115913 | 115928 | GACAACTCTTATATGG | $G_{ks}A_{ks}^mC_{ds}A_{ds}A_{ds}^mC_{ds}T_{ds}^mC_{ds}T_{ds}T_{ds}A_{ds}T_{ds}A_{ks}T_{es}G_{ks}G_e$ | 78 | 2862 |
| 1198693 | N/A | N/A | 117332 | 117347 | ATGTAATATTGCAATC | $A_{ks}T_{ks}G_{ds}T_{ds}A_{ds}A_{ds}T_{ds}A_{ds}T_{ds}T_{ds}G_{ds}^mC_{ds}A_{ks}A_{es}T_{ks}^mC_e$ | 92 | 2848 |
| 1198694 | N/A | N/A | 117333 | 117348 | TATGTAATATTGCAAT | $T_{ks}A_{ks}T_{ds}G_{ds}T_{ds}A_{ds}A_{ds}T_{ds}A_{ds}T_{ds}T_{ds}G_{ds}^mC_{ks}A_{es}A_{ks}T_e$ | 110 | 2849 |
| 1198695 | N/A | N/A | 117335 | 117350 | TTTATGTAATATTGCA | $T_{ks}T_{ks}T_{ds}A_{ds}T_{ds}G_{ds}T_{ds}A_{ds}A_{ds}T_{ds}A_{ds}T_{ds}T_{ks}G_{es}^mC_{ks}A_e$ | 75 | 2850 |
| 1198696 | N/A | N/A | 117755 | 117770 | TGTATGTCAGAAGAGT | $T_{ks}G_{ks}T_{ds}A_{ds}T_{ds}G_{ds}T_{ds}^mC_{ds}A_{ds}G_{ds}A_{ds}A_{ds}G_{ks}A_{es}G_{ks}T_e$ | 12 | 2863 |

TABLE 42-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198697 | N/A | N/A | 117757 | 117772 | AGTGTATGTCAGAAGA | $A_{ks}G_{ks}T_{ds}G_{ds}T_{ds}A_{ds}T_{ds}G_{ds}T_{ds}{}^mC_{ds}A_{ds}G_{ds}A_{ks}A_{es}G_{ks}A_{e}$ | 12 | 2864 |
| 1198698 | N/A | N/A | 117758 | 117773 | AAGTGTATGTCAGAAG | $A_{ks}A_{ks}G_{ds}T_{ds}G_{ds}T_{ds}A_{ds}T_{ds}G_{ds}T_{ds}{}^mC_{ds}A_{ds}G_{ks}A_{es}A_{ks}G_{e}$ | 12 | 2865 |
| 1198699 | N/A | N/A | 117759 | 117774 | AAAGTGTATGTCAGAA | $A_{ks}A_{ks}A_{ds}G_{ds}T_{ds}G_{ds}T_{ds}A_{ds}T_{ds}G_{ds}T_{ds}{}^mC_{ds}A_{ks}G_{es}A_{ks}A_{e}$ | 30 | 2866 |
| 1198700 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{ds}{}^mC_{ds}A_{es}G_{ks}A_{e}$ | 26 | 2867 |
| 1198701 | N/A | N/A | 117761 | 117776 | TTAAAGTGTATGTCAG | $T_{ks}T_{ks}A_{ds}A_{ds}A_{ds}G_{ds}T_{ds}G_{ds}T_{ds}A_{ds}T_{ds}G_{ds}T_{ks}{}^mC_{es}A_{ks}G_{e}$ | 46 | 2868 |
| 1198702 | N/A | N/A | 117762 | 117777 | TTTAAAGTGTATGTCA | $T_{ks}T_{ks}T_{ds}A_{ds}A_{ds}A_{ds}G_{ds}T_{ds}G_{ds}T_{ds}A_{ds}T_{ds}G_{ks}T_{es}{}^mC_{ks}A_{e}$ | 74 | 2869 |
| 1198703 | N/A | N/A | 117763 | 117778 | CTTTAAAGTGTATGTC | ${}^mC_{ks}T_{ks}T_{ds}T_{ds}A_{ds}A_{ds}A_{ds}G_{ds}T_{ds}G_{ds}T_{ds}A_{ds}T_{ks}G_{es}T_{ks}{}^mC_{e}$ | 42 | 1634 |
| 1198704 | N/A | N/A | 117765 | 117780 | AACTTTAAAGTGTATG | $A_{ks}A_{ks}{}^mC_{ds}T_{ds}T_{ds}T_{ds}A_{ds}A_{ds}A_{ds}G_{ds}T_{ds}G_{ds}T_{ds}A_{es}T_{ks}G_{e}$ | 72 | 2870 |
| 1198705 | N/A | N/A | 119667 | 119682 | TAAGGTTTCCCAGATT | $T_{ks}A_{ks}A_{ds}G_{ds}G_{ds}T_{ds}T_{ds}T_{ds}{}^mC_{ds}{}^mC_{ds}{}^mC_{ds}A_{ds}G_{ks}A_{es}T_{ks}T_{e}$ | 70 | 2851 |
| 1198706 | N/A | N/A | 119669 | 119684 | AGTAAGGTTTCCCAGA | $A_{ks}G_{ks}T_{ds}A_{ds}A_{ds}G_{ds}G_{ds}T_{ds}T_{ds}T_{ds}{}^mC_{ds}{}^mC_{ds}{}^mC_{ks}A_{es}G_{ks}A_{e}$ | 39 | 2852 |
| 1198707 | N/A | N/A | 119670 | 119685 | AAGTAAGGTTTCCCAG | $A_{ks}A_{ks}G_{ds}T_{ds}A_{ds}A_{ds}G_{ds}G_{ds}T_{ds}T_{ds}{}^mC_{ds}{}^mC_{ds}{}^mC_{ks}{}^mC_{es}A_{ks}G_{e}$ | 31 | 2853 |
| 1198708 | N/A | N/A | 119671 | 119686 | TAAGTAAGGTTTCCCA | $T_{ks}A_{ks}A_{ds}G_{ds}T_{ds}A_{ds}A_{ds}G_{ds}G_{ds}T_{ds}T_{ds}T_{ds}{}^mC_{ks}{}^mC_{es}{}^mC_{ks}A_{e}$ | 34 | 2854 |
| 1198709 | N/A | N/A | 119672 | 119687 | CTAAGTAAGGTTTCCC | ${}^mC_{ks}T_{ks}A_{ds}A_{ds}G_{ds}T_{ds}A_{ds}A_{ds}G_{ds}G_{ds}T_{ds}T_{ds}T_{ks}{}^mC_{es}{}^mC_{ks}{}^mC_{e}$ | 29 | 1101 |
| 1198710 | N/A | N/A | 119673 | 119688 | ACTAAGTAAGGTTTCC | $A_{ks}{}^mC_{ks}T_{ds}A_{ds}A_{ds}G_{ds}T_{ds}A_{ds}A_{ds}G_{ds}G_{ds}T_{ds}T_{ks}T_{es}{}^mC_{ks}{}^mC_{e}$ | 51 | 2855 |
| 1198711 | N/A | N/A | 119674 | 119689 | GACTAAGTAAGGTTTC | $G_{ks}A_{ks}{}^mC_{ds}T_{ds}A_{ds}A_{ds}G_{ds}T_{ds}A_{ds}A_{ds}G_{ds}G_{ds}T_{ks}T_{es}T_{ks}{}^mC_{e}$ | 60 | 2856 |
| 1198712 | N/A | N/A | 119675 | 119690 | AGACTAAGTAAGGTTT | $A_{ks}G_{ks}A_{ds}{}^mC_{ds}T_{ds}A_{ds}A_{ds}G_{ds}T_{ds}A_{ds}A_{ds}G_{ds}G_{ks}T_{es}T_{ks}T_{e}$ | 110 | 2857 |
| 1198713 | N/A | N/A | 119677 | 119692 | TTAGACTAAGTAAGGT | $T_{ks}T_{ks}A_{ds}G_{ds}A_{ds}{}^mC_{ds}T_{ds}A_{ds}A_{ds}G_{ds}T_{ds}A_{ds}A_{ks}G_{es}G_{ks}T_{e}$ | 62 | 2858 |

TABLE 43

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_{k}$ | 25 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_{k}$ | 14 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_{k}$ | 11 | 2800 |
| 1095575 | 4443 | 4458 | 125468 | 125483 | ACTGAGGTATAACTGG | $A_{ks}{}^mC_{ks}T_{ds}G_{ds}A_{ds}G_{ds}G_{ds}T_{ds}A_{ds}T_{ds}A_{ds}A_{es}{}^mC_{es}T_{es}G_{ds}G_{k}$ | 55 | 392 |
| 1095593 | 4441 | 4456 | 125466 | 125481 | TGAGGTATAACTGGGC | $T_{ks}G_{ks}A_{ds}G_{ds}G_{ds}T_{ds}A_{ds}T_{ds}A_{ds}A_{ds}{}^mC_{ds}T_{es}G_{es}G_{es}G_{ks}{}^mC_{k}$ | 16 | 1580 |
| 1095594 | 4442 | 4457 | 125467 | 125482 | CTGAGGTATAACTGGG | ${}^mC_{ks}T_{ks}G_{ds}A_{ds}G_{ds}G_{ds}T_{ds}A_{ds}T_{ds}A_{ds}A_{ds}{}^mC_{es}T_{es}G_{es}G_{ks}G_{k}$ | 27 | 2801 |
| 1095595 | 4444 | 4459 | 125469 | 125484 | CACTGAGGTATAACTG | ${}^mC_{ks}A_{ks}{}^mC_{ds}T_{ds}G_{ds}A_{ds}G_{ds}G_{ds}T_{ds}A_{ds}T_{ds}A_{es}A_{es}{}^mC_{es}T_{ks}G_{k}$ | 63 | 2802 |
| 1198216 | 4436 | 4451 | 125461 | 125476 | TATAACTGGGCAAATT | $T_{ks}A_{ks}T_{ds}A_{ds}A_{ds}{}^mC_{ds}T_{ds}G_{ds}G_{ds}G_{ds}{}^mC_{ds}A_{ds}A_{es}A_{es}T_{ks}T_{k}$ | 89 | 2815 |
| 1198217 | 4438 | 4453 | 125463 | 125478 | GGTATAACTGGGCAAA | $G_{ks}G_{ks}T_{ds}A_{ds}T_{ds}A_{ds}A_{ds}{}^mC_{ds}T_{ds}G_{ds}G_{ds}G_{es}{}^mC_{es}A_{es}A_{ks}A_{k}$ | 57 | 1427 |
| 1198218 | 4439 | 4454 | 125464 | 125479 | AGGTATAACTGGGCAA | $A_{ks}G_{ks}G_{ds}T_{ds}A_{ds}T_{ds}A_{ds}A_{ds}{}^mC_{ds}T_{ds}G_{ds}G_{es}G_{es}{}^mC_{es}A_{ks}A_{k}$ | 40 | 905 |
| 1198219 | 4440 | 4455 | 125465 | 125480 | GAGGTATAACTGGGCA | $G_{ks}A_{ks}G_{ds}G_{ds}T_{ds}A_{ds}T_{ds}A_{ds}A_{ds}{}^mC_{ds}T_{ds}G_{es}G_{es}G_{es}{}^mC_{ks}A_{k}$ | 22 | 1503 |
| 1198220 | 4446 | 4461 | 125471 | 125486 | AACACTGAGGTATAAC | $A_{ks}A_{ks}{}^mC_{ds}A_{ds}{}^mC_{ds}T_{ds}G_{ds}A_{ds}G_{ds}G_{ds}T_{ds}A_{es}T_{es}A_{es}A_{ks}{}^mC_{k}$ | 89 | 2816 |

TABLE 43-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198241 | N/A | N/A | 94732 | 94747 | TTTAGGATGCATGGTT | $T_{ks}T_{ks}T_{ds}A_{ds}G_{ds}G_{ds}A_{ds}T_{ds}G_{ds}{}^mC_{ds}A_{ds}T_{es}G_{es}G_{es}T_{ks}T_k$ | 32 | 2832 |
| 1198242 | N/A | N/A | 94733 | 94748 | ATTTAGGATGCATGGT | $A_{ks}T_{ks}T_{ds}T_{ds}A_{ds}G_{ds}G_{ds}A_{ds}T_{ds}G_{ds}{}^mC_{ds}A_{es}T_{es}G_{es}G_{ks}T_k$ | 47 | 2833 |
| 1198243 | N/A | N/A | 94734 | 94749 | GATTTAGGATGCATGG | $G_{ks}A_{ks}T_{ds}T_{ds}T_{ds}A_{ds}G_{ds}G_{ds}A_{ds}T_{ds}G_{ds}{}^mC_{es}A_{es}T_{es}G_{ks}G_k$ | 8 | 2834 |
| 1198244 | N/A | N/A | 94735 | 94750 | AGATTTAGGATGCATG | $A_{ks}G_{ks}A_{ds}T_{ds}T_{ds}T_{ds}A_{ds}G_{ds}G_{ds}A_{ds}T_{ds}G_{es}{}^mC_{es}A_{es}T_{ks}G_k$ | 24 | 2835 |
| 1198245 | N/A | N/A | 94736 | 94751 | CAGATTTAGGATGCAT | ${}^mC_{ks}A_{ks}G_{ds}A_{ds}T_{ds}T_{ds}T_{ds}A_{ds}G_{ds}G_{ds}A_{ds}T_{es}G_{es}{}^mC_{es}A_{ks}T_k$ | 46 | 2836 |
| 1198246 | N/A | N/A | 94737 | 94752 | TCAGATTTAGGATGCA | $T_{ks}{}^mC_{ks}A_{ds}G_{ds}A_{ds}T_{ds}T_{ds}T_{ds}A_{ds}G_{ds}G_{ds}A_{ds}T_{es}G_{es}{}^mC_{ks}A_k$ | 30 | 2837 |
| 1198247 | N/A | N/A | 94739 | 94754 | ATTCAGATTTAGGATG | $A_{ks}T_{ks}T_{ds}{}^mC_{ds}A_{ds}G_{ds}A_{ds}T_{ds}T_{ds}T_{ds}A_{ds}G_{es}G_{es}A_{es}T_{ks}G_k$ | 99 | 2838 |
| 1198248 | N/A | N/A | 115903 | 115918 | ATATGGTTTTGTGTGT | $A_{ks}T_{ks}A_{ds}T_{ds}G_{ds}G_{ds}T_{ds}T_{ds}T_{ds}T_{ds}G_{ds}T_{es}G_{es}T_{es}G_{ks}T_k$ | 64 | 2839 |
| 1198249 | N/A | N/A | 115905 | 115920 | TTATATGGTTTTGTGT | $T_{ks}T_{ks}A_{ds}T_{ds}A_{ds}T_{ds}G_{ds}G_{ds}T_{ds}T_{ds}T_{ds}T_{es}G_{es}T_{es}G_{ks}T_k$ | 42 | 2840 |
| 1198250 | N/A | N/A | 115906 | 115921 | CTTATATGGTTTTGTG | ${}^mC_{ks}T_{ks}T_{ds}A_{ds}T_{ds}A_{ds}T_{ds}G_{ds}G_{ds}T_{ds}T_{es}T_{es}T_{es}G_{es}T_{ks}G_k$ | 50 | 2788 |
| 1198251 | N/A | N/A | 115907 | 115922 | TCTTATATGGTTTTGT | $T_{ks}{}^mC_{ks}T_{ds}T_{ds}A_{ds}T_{ds}A_{ds}T_{ds}G_{ds}G_{ds}T_{ds}T_{es}T_{es}T_{es}G_{ks}T_k$ | 83 | 2841 |
| 1198252 | N/A | N/A | 115908 | 115923 | CTCTTATATGGTTTTG | ${}^mC_{ks}T_{ks}{}^mC_{ds}T_{ds}T_{ds}A_{ds}T_{ds}A_{ds}T_{ds}G_{ds}G_{ds}T_{es}T_{es}T_{es}T_{ks}G_k$ | 26 | 2842 |
| 1198253 | N/A | N/A | 115909 | 115924 | ACTCTTATATGGTTTT | $A_{ks}{}^mC_{ds}T_{ds}{}^mC_{ds}T_{ds}T_{ds}A_{ds}T_{ds}A_{ds}T_{ds}G_{ds}G_{es}T_{es}T_{es}T_{ks}T_k$ | 50 | 2859 |
| 1198254 | N/A | N/A | 115910 | 115925 | AACTCTTATATGGTTT | $A_{ks}A_{ks}{}^mC_{ds}T_{ds}{}^mC_{ds}T_{ds}T_{ds}A_{ds}T_{ds}A_{ds}T_{ds}G_{es}G_{es}T_{es}T_{ks}T_k$ | 95 | 2860 |
| 1198255 | N/A | N/A | 115911 | 115926 | CAACTCTTATATGGTT | ${}^mC_{ks}A_{ks}A_{ds}{}^mC_{ds}T_{ds}{}^mC_{ds}T_{ds}T_{ds}A_{ds}T_{ds}A_{ds}T_{es}G_{es}G_{es}T_{ks}T_k$ | 84 | 2861 |
| 1198256 | N/A | N/A | 115913 | 115928 | GACAACTCTTATATGG | $G_{ks}A_{ks}{}^mC_{ds}A_{ds}A_{ds}{}^mC_{ds}T_{ds}{}^mC_{ds}T_{ds}T_{ds}A_{ds}T_{es}A_{es}T_{es}G_{ks}G_k$ | 78 | 2862 |
| 1198257 | N/A | N/A | 117325 | 117340 | ATTGCAATCTGTCTGA | $A_{ks}T_{ds}T_{ds}G_{ds}{}^mC_{ds}A_{ds}A_{ds}T_{ds}{}^mC_{ds}T_{ds}G_{ds}T_{es}{}^mC_{es}T_{es}G_{ks}A_k$ | 85 | 2843 |
| 1198258 | N/A | N/A | 117327 | 117342 | ATATTGCAATCTGTCT | $A_{ks}T_{ks}A_{ds}T_{ds}T_{ds}G_{ds}{}^mC_{ds}A_{ds}A_{ds}T_{ds}{}^mC_{ds}T_{es}G_{es}T_{es}{}^mC_{ks}T_k$ | 52 | 2844 |
| 1198259 | N/A | N/A | 117328 | 117343 | AATATTGCAATCTGTC | $A_{ks}A_{ks}T_{ds}A_{ds}T_{ds}T_{ds}G_{ds}{}^mC_{ds}A_{ds}A_{ds}T_{ds}{}^mC_{es}T_{es}G_{es}T_{ks}{}^mC_k$ | 51 | 2845 |
| 1198260 | N/A | N/A | 117329 | 117344 | TAATATTGCAATCTGT | $T_{ks}A_{ks}A_{ds}T_{ds}A_{ds}T_{ds}T_{ds}G_{ds}{}^mC_{ds}A_{ds}A_{ds}T_{es}{}^mC_{es}T_{es}G_{ks}T_k$ | 106 | 2846 |
| 1198261 | N/A | N/A | 117330 | 117345 | GTAATATTGCAATCTG | $G_{ks}T_{ks}A_{ds}A_{ds}T_{ds}A_{ds}T_{ds}T_{ds}G_{ds}{}^mC_{ds}A_{ds}A_{es}T_{es}{}^mC_{es}T_{ks}G_k$ | 54 | 1404 |
| 1198262 | N/A | N/A | 117331 | 117346 | TGTAATATTGCAATCT | $T_{ks}G_{ks}T_{ds}A_{ds}A_{ds}T_{ds}A_{ds}T_{ds}T_{ds}G_{ds}{}^mC_{ds}A_{es}A_{es}T_{es}{}^mC_{ks}T_k$ | 114 | 2847 |
| 1198263 | N/A | N/A | 117332 | 117347 | ATGTAATATTGCAATC | $A_{ks}T_{ks}G_{ds}T_{ds}A_{ds}A_{ds}T_{ds}A_{ds}T_{ds}T_{ds}G_{ds}{}^mC_{es}A_{es}A_{es}T_{ks}{}^mC_k$ | 114 | 2848 |
| 1198264 | N/A | N/A | 117333 | 117348 | TATGTAATATTGCAAT | $T_{ks}A_{ks}T_{ds}G_{ds}T_{ds}A_{ds}A_{ds}T_{ds}A_{ds}T_{ds}T_{ds}G_{es}{}^mC_{es}A_{es}A_{ks}T_k$ | 73 | 2849 |
| 1198265 | N/A | N/A | 117335 | 117350 | TTTATGTAATATTGCA | $T_{ks}T_{ks}T_{ds}A_{ds}T_{ds}G_{ds}T_{ds}A_{ds}A_{ds}T_{ds}A_{ds}T_{es}T_{es}G_{es}{}^mC_{ks}A_k$ | 111 | 2850 |
| 1198266 | N/A | N/A | 117755 | 117770 | TGTATGTCAGAAGAGT | $T_{ks}G_{ks}T_{ds}A_{ds}T_{ds}G_{ds}T_{ds}{}^mC_{ds}A_{ds}G_{ds}A_{ds}A_{es}G_{es}A_{es}G_{ks}T_k$ | 25 | 2863 |
| 1198267 | N/A | N/A | 117757 | 117772 | AGTGTATGTCAGAAGA | $A_{ks}G_{ks}T_{ds}G_{ds}T_{ds}A_{ds}T_{ds}G_{ds}T_{ds}{}^mC_{ds}A_{ds}G_{es}A_{es}A_{es}G_{ks}A_k$ | 7 | 2864 |
| 1198268 | N/A | N/A | 117758 | 117773 | AAGTGTATGTCAGAAG | $A_{ks}A_{ks}G_{ds}T_{ds}G_{ds}T_{ds}A_{ds}T_{ds}G_{ds}T_{ds}{}^mC_{ds}A_{es}G_{es}A_{es}A_{ks}G_k$ | 11 | 2865 |
| 1198269 | N/A | N/A | 117759 | 117774 | AAAGTGTATGTCAGAA | $A_{ks}A_{ks}A_{ds}G_{ds}T_{ds}G_{ds}T_{ds}A_{ds}T_{ds}G_{ds}T_{ds}{}^mC_{es}A_{es}G_{es}A_{ks}A_k$ | 58 | 2866 |
| 1198270 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{es}{}^mC_{es}A_{es}G_{ks}A_k$ | 52 | 2867 |
| 1198271 | N/A | N/A | 117761 | 117776 | TTAAAGTGTATGTCAG | $T_{ks}T_{ks}A_{ds}A_{ds}A_{ds}G_{ds}T_{ds}G_{ds}T_{ds}A_{ds}T_{ds}G_{es}T_{es}{}^mC_{es}A_{ks}G_k$ | 44 | 2868 |
| 1198272 | N/A | N/A | 117762 | 117777 | TTTAAAGTGTATGTCA | $T_{ks}T_{ks}T_{ds}A_{ds}A_{ds}A_{ds}G_{ds}T_{ds}G_{ds}T_{ds}A_{ds}T_{es}G_{es}T_{es}{}^mC_{ks}A_k$ | 37 | 2869 |
| 1198273 | N/A | N/A | 117763 | 117778 | CTTTAAAGTGTATGTC | ${}^mC_{ks}T_{ks}T_{ds}T_{ds}A_{ds}A_{ds}A_{ds}G_{ds}T_{ds}G_{ds}T_{ds}A_{es}T_{es}G_{es}T_{ks}{}^mC_k$ | 52 | 1634 |
| 1198274 | N/A | N/A | 117765 | 117780 | AACTTTAAAGTGTATG | $A_{ks}A_{ks}{}^mC_{ds}T_{ds}T_{ds}T_{ds}A_{ds}A_{ds}A_{ds}G_{ds}T_{ds}G_{es}T_{es}A_{es}T_{ks}G_k$ | 69 | 2870 |
| 1198275 | N/A | N/A | 119667 | 119682 | TAAGGTTTCCCAGATT | $T_{ks}A_{ks}A_{ds}G_{ds}G_{ds}T_{ds}T_{ds}T_{ds}{}^mC_{ds}{}^mC_{ds}{}^mC_{ds}A_{es}G_{es}A_{es}T_{ks}T_k$ | 52 | 2851 |
| 1198276 | N/A | N/A | 119669 | 119684 | AGTAAGGTTTCCCAGA | $A_{ks}G_{ks}T_{ds}A_{ds}A_{ds}G_{ds}G_{ds}T_{ds}T_{ds}T_{ds}{}^mC_{ds}{}^mC_{es}{}^mC_{es}A_{es}G_{ks}A_k$ | 52 | 2852 |

TABLE 43-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198277 | N/A | N/A | 119670 | 119685 | AAGTAAGGTTTCCCAG | $A_{ks}A_{ks}G_{ds}T_{ds}A_{ds}A_{ds}G_{ds}G_{ds}T_{ds}T_{ds}T_{ds}{}^mC_{es}{}^mC_{es}{}^mC_{es}A_{ks}G_{k}$ | 32 | 2853 |
| 1198278 | N/A | N/A | 119671 | 119686 | TAAGTAAGGTTTCCCA | $T_{ks}A_{ks}A_{ds}G_{ds}T_{ds}A_{ds}A_{ds}G_{ds}G_{ds}T_{ds}T_{ds}T_{es}{}^mC_{es}{}^mC_{es}{}^mC_{ks}A_{k}$ | 43 | 2854 |
| 1198279 | N/A | N/A | 119672 | 119687 | CTAAGTAAGGTTTCCC | ${}^mC_{ks}T_{ks}A_{ds}A_{ds}G_{ds}T_{ds}A_{ds}A_{ds}G_{ds}G_{ds}T_{ds}T_{es}T_{es}{}^mC_{es}{}^mC_{ks}{}^mC_{k}$ | 43 | 1101 |
| 1198280 | N/A | N/A | 119673 | 119688 | ACTAAGTAAGGTTTCC | $A_{ks}{}^mC_{ks}T_{ds}A_{ds}A_{ds}G_{ds}T_{ds}A_{ds}A_{ds}G_{ds}G_{ds}T_{es}T_{es}T_{es}{}^mC_{ks}{}^mC_{k}$ | 40 | 2855 |
| 1198281 | N/A | N/A | 119674 | 119689 | GACTAAGTAAGGTTTC | $G_{ks}A_{ks}{}^mC_{ds}T_{ds}A_{ds}A_{ds}G_{ds}T_{ds}A_{ds}A_{ds}G_{ds}G_{ds}T_{es}T_{es}T_{ks}{}^mC_{k}$ | 71 | 2856 |
| 1198282 | N/A | N/A | 119675 | 119690 | AGACTAAGTAAGGTTT | $A_{ks}G_{ks}A_{ds}{}^mC_{ds}T_{ds}A_{ds}A_{ds}G_{ds}T_{ds}A_{ds}A_{ds}G_{es}G_{es}T_{es}T_{ks}T_{k}$ | 58 | 2857 |
| 1198283 | N/A | N/A | 119677 | 119692 | TTAGACTAAGTAAGGT | $T_{ks}T_{ks}A_{ds}G_{ds}A_{ds}{}^mC_{ds}T_{ds}A_{ds}A_{ds}G_{ds}T_{ds}A_{es}A_{es}G_{es}G_{ks}T_{k}$ | 99 | 2858 |
| 1198456 | 2524 | 2539 | 123549 | 123564 | TGTCTCATGCCTTATA | $T_{ks}G_{ks}T_{ds}{}^mC_{ds}T_{ds}{}^mC_{ds}A_{ds}T_{ds}G_{ds}{}^mC_{ds}{}^mC_{ds}T_{es}T_{ks}A_{ks}T_{ks}A_{e}$ | 21 | 2803 |
| 1198457 | 2526 | 2541 | 123551 | 123566 | ATTGTCTCATGCCTTA | $A_{ks}T_{ks}T_{ds}G_{ds}T_{ds}{}^mC_{ds}T_{ds}{}^mC_{ds}A_{ds}T_{ds}G_{ds}{}^mC_{es}{}^mC_{ks}T_{es}T_{ks}A_{e}$ | 18 | 2804 |
| 1198458 | 2527 | 2542 | 123552 | 123567 | AATTGTCTCATGCCTT | $A_{ks}A_{ks}T_{ds}T_{ds}G_{ds}T_{ds}{}^mC_{ds}T_{ds}{}^mC_{ds}A_{ds}T_{ds}G_{es}{}^mC_{ks}{}^mC_{es}T_{ks}T_{e}$ | 30 | 2805 |
| 1198459 | 2528 | 2543 | 123553 | 123568 | AAATTGTCTCATGCCT | $A_{ks}A_{ks}A_{ds}T_{ds}T_{ds}G_{ds}T_{ds}{}^mC_{ds}T_{ds}{}^mC_{ds}A_{ds}T_{es}G_{ks}{}^mC_{es}{}^mC_{ks}T_{e}$ | 28 | 443 |
| 1198460 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{es}T_{ks}G_{es}{}^mC_{ks}{}^mC_{e}$ | 17 | 2800 |
| 1198461 | 2530 | 2545 | 123555 | 123570 | GGAAATTGTCTCATGC | $G_{ks}G_{ks}A_{ds}A_{ds}A_{ds}T_{ds}T_{ds}G_{ds}T_{ds}{}^mC_{ds}T_{ds}{}^mC_{es}A_{ks}T_{es}G_{ks}{}^mC_{e}$ | 24 | 2806 |
| 1198462 | 2531 | 2546 | 123556 | 123571 | TGGAAATTGTCTCATG | $T_{ks}G_{ks}G_{ds}A_{ds}A_{ds}A_{ds}T_{ds}T_{ds}G_{ds}T_{ds}{}^mC_{ds}T_{es}{}^mC_{ks}A_{ks}T_{ks}G_{e}$ | 27 | 2807 |
| 1198463 | 2532 | 2547 | 123557 | 123572 | ATGGAAATTGTCTCAT | $A_{ks}T_{ks}G_{ds}G_{ds}A_{ds}A_{ds}A_{ds}T_{ds}T_{ds}G_{ds}T_{ds}{}^mC_{es}T_{ks}{}^mC_{es}A_{ks}T_{e}$ | 59 | 2808 |
| 1198464 | 2534 | 2549 | 123559 | 123574 | ATATGGAAATTGTCTC | $A_{ks}T_{ks}A_{ds}T_{ds}G_{ds}G_{ds}A_{ds}A_{ds}A_{ds}T_{ds}T_{ds}G_{es}T_{ks}{}^mC_{es}T_{ks}{}^mC_{e}$ | 41 | 656 |
| 1198465 | 2560 | 2575 | 123585 | 123600 | AGTATGTGGCAATAAT | $A_{ks}G_{ks}T_{ds}A_{ds}T_{ds}G_{ds}T_{ds}G_{ds}G_{ds}{}^mC_{ds}A_{ds}A_{es}T_{es}A_{es}A_{ks}T_{e}$ | 68 | 2809 |
| 1198466 | 2562 | 2577 | 123587 | 123602 | AGAGTATGTGGCAATA | $A_{ks}G_{ks}A_{ds}G_{ds}T_{ds}A_{ds}T_{ds}G_{ds}T_{ds}G_{ds}G_{ds}{}^mC_{es}A_{ks}A_{es}T_{ks}A_{e}$ | 12 | 2810 |
| 1198467 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}G_{es}{}^mC_{ks}A_{es}A_{ks}T_{e}$ | 27 | 2811 |
| 1198468 | 2564 | 2579 | 123589 | 123604 | TTAGAGTATGTGGCAA | $T_{ks}T_{ks}A_{ds}G_{ds}A_{ds}G_{ds}T_{ds}A_{ds}T_{ds}G_{ds}T_{ds}G_{es}G_{ks}{}^mC_{es}AlcsA_{e}$ | 22 | 963 |
| 1198469 | 2565 | 2580 | 123590 | 123605 | ATTAGAGTATGTGGCA | $A_{ks}T_{ks}T_{ds}A_{ds}G_{ds}A_{ds}G_{ds}T_{ds}A_{ds}T_{ds}G_{ds}T_{es}G_{ks}G_{es}{}^mC_{ks}A_{e}$ | 23 | 810 |
| 1198470 | 2566 | 2581 | 123591 | 123606 | TATTAGAGTATGTGGC | $T_{ks}A_{ks}T_{ds}T_{ds}A_{ds}G_{ds}A_{ds}G_{ds}T_{ds}A_{ds}T_{ds}G_{es}T_{ks}G_{ks}G_{k}{}^mC_{e}$ | 17 | 2812 |
| 1198471 | 2567 | 2582 | 123592 | 123607 | ATATTAGAGTATGTGG | $A_{ks}T_{ks}A_{ds}T_{ds}T_{ds}A_{ds}G_{ds}A_{ds}G_{ds}T_{ds}A_{ds}T_{es}G_{ks}T_{es}G_{ks}G_{e}$ | 21 | 2813 |
| 1198472 | 2568 | 2583 | 123593 | 123608 | TATATTAGAGTATGTG | $T_{ks}A_{ks}T_{ds}A_{ds}T_{ds}T_{ds}A_{ds}G_{ds}A_{ds}G_{ds}T_{ds}A_{es}T_{ks}G_{es}T_{ks}G_{e}$ | 60 | 2814 |
| 1198473 | 2570 | 2585 | 123595 | 123610 | TCTATATTAGAGTATG | $T_{kshu}{}^mC_{ks}T_{ds}A_{ds}T_{ds}A_{ds}T_{ds}T_{ds}A_{ds}G_{ds}A_{ds}G_{es}T_{ks}A_{es}T_{ks}G_{e}$ | 66 | 887 |
| 1198479 | 4595 | 4610 | 125620 | 125635 | TTACATTAGGAACAAG | $T_{ks}T_{ks}A_{ds}{}^mC_{ds}A_{ds}T_{ds}T_{ds}A_{ds}G_{ds}G_{ds}A_{ds}A_{es}{}^mC_{ks}A_{es}A_{ks}G_{e}$ | 65 | 2817 |
| 1198480 | 4597 | 4612 | 125622 | 125637 | TTTTACATTAGGAACA | $T_{ks}T_{ks}T_{ds}T_{ds}A_{ds}{}^mC_{ds}A_{ds}T_{ds}T_{ds}A_{ds}G_{ds}G_{es}A_{ks}A_{es}{}^mC_{ks}A_{e}$ | 75 | 2818 |
| 1198481 | 4598 | 4613 | 125623 | 125638 | CTTTTACATTAGGAAC | ${}^mC_{ks}T_{ks}T_{ds}T_{ds}T_{ds}A_{ds}{}^mC_{ds}A_{ds}T_{ds}T_{ds}A_{ds}G_{es}G_{ks}A_{es}A_{ks}{}^mC_{e}$ | 72 | 1124 |
| 1198482 | 4599 | 4614 | 125624 | 125639 | ACTTTTACATTAGGAA | $A_{ks}{}^mX_{ks}T_{ds}T_{ds}T_{ds}A_{ds}{}^mC_{ds}A_{ds}T_{ds}T_{ds}A_{es}G_{ks}G_{es}A_{ks}A_{e}$ | 63 | 2819 |
| 1198483 | 4600 | 4615 | 125625 | 125640 | CACTTTTACATTAGGA | ${}^mC_{ks}A_{ks}{}^mC_{ds}T_{ds}T_{ds}T_{ds}T_{ds}A_{ds}{}^mC_{ds}A_{ds}T_{ds}T_{es}A_{ks}G_{es}G_{ks}A_{e}$ | 31 | 1200 |
| 1198484 | 4601 | 4616 | 125626 | 125641 | GCACTTTTACATTAGG | $G_{ks}{}^mC_{ks}A_{ds}{}^mC_{ds}T_{ds}T_{ds}T_{ds}T_{ds}A_{ds}{}^mC_{ds}A_{ds}T_{es}T_{ks}A_{es}G_{ks}G_{e}$ | 18 | 1276 |
| 1198485 | 4602 | 4617 | 125627 | 125642 | AGCACTTTTACATTAG | $A_{ks}G_{ks}{}^mC_{ds}A_{ds}{}^mC_{ds}T_{ds}T_{ds}T_{ds}T_{ds}A_{ds}{}^mC_{ds}A_{es}T_{ks}T_{es}A_{ks}G_{e}$ | 64 | 2820 |

TABLE 44

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 18 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 9 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 7 | 2800 |
| 1095603 | 4443 | 4458 | 125468 | 125483 | ACTGAGGTATAACTGG | $A_{ks}{}^mC_{ks}T_{ds}G_{ds}A_{ds}G_{ds}G_{ds}T_{ds}A_{ds}T_{ds}A_{ds}A_{es}{}^mC_{ks}T_{es}G_{ks}G_e$ | 29 | 2872 |
| 1095621 | 4441 | 4456 | 125466 | 125481 | TGAGGTATAACTGGGC | $T_{ks}G_{ks}A_{ds}G_{ds}G_{ds}T_{ds}A_{ds}T_{ds}A_{ds}A_{ds}{}^mC_{ds}T_{es}G_{ks}G_{es}G_{ks}{}^mC_e$ | 22 | 1580 |
| 1095622 | 4442 | 4457 | 125467 | 125482 | CTGAGGTATAACTGGG | $^mC_{ks}T_{ks}G_{ds}A_{ds}G_{ds}G_{ds}T_{ds}A_{ds}T_{ds}A_{ds}A_{ds}{}^mC_{es}T_{ks}G_{es}G_{ks}G_e$ | 44 | 2801 |
| 1095623 | 4444 | 4459 | 125469 | 125484 | CACTGAGGTATAACTG | $^mC_{ks}A_{ks}{}^mC_{ds}T_{ds}G_{ds}A_{ds}G_{ds}G_{ds}T_{ds}A_{ds}T_{ds}A_{es}A_{ks}{}^mC_{es}T_{ks}G_e$ | 57 | 2802 |
| 1198474 | 4436 | 4451 | 125461 | 125476 | TATAACTGGGCAAATT | $T_{ks}A_{ks}T_{ds}A_{ds}A_{ds}{}^mC_{ds}T_{ds}G_{ds}G_{ds}G_{ds}{}^mC_{ds}A_{es}A_{ks}A_{es}T_{ks}T_e$ | 68 | 2815 |
| 1198475 | 4438 | 4453 | 125463 | 125478 | GGTATAACTGGGCAAA | $G_{ks}G_{ks}T_{ds}A_{ds}T_{ds}A_{ds}A_{ds}{}^mC_{ds}T_{ds}G_{ds}G_{ds}G_{es}{}^mC_{es}A_{ks}A_{ks}A_e$ | 25 | 1427 |
| 1198476 | 4439 | 4454 | 125464 | 125479 | AGGTATAACTGGGCAA | $A_{ks}G_{ks}G_{ds}T_{ds}A_{ds}T_{ds}A_{ds}A_{ds}{}^mC_{ds}T_{ds}G_{ds}G_{es}G_{ks}{}^mC_{es}A_{ks}A_e$ | 31 | 905 |
| 1198477 | 4440 | 4455 | 125465 | 125480 | GAGGTATAACTGGGCA | $G_{ks}A_{ks}G_{ds}G_{ds}T_{ds}A_{ds}T_{ds}A_{ds}A_{ds}{}^mC_{ds}T_{ds}G_{ds}G_{es}G_{ks}{}^mC_{ks}A_e$ | 47 | 1503 |
| 1198478 | 4446 | 4461 | 125471 | 125486 | AACACTGAGGTATAAC | $A_{ks}A_{ks}{}^mC_{ds}A_{ds}{}^mC_{ds}T_{ds}G_{ds}A_{ds}G_{ds}G_{ds}T_{ds}A_{es}T_{ks}A_{es}A_{ks}{}^mC_e$ | 60 | 2816 |
| 1198486 | 4603 | 4618 | 125628 | 125643 | AAGCACTTTTACATTA | $A_{ks}A_{ks}G_{ds}{}^mC_{ds}A_{ds}{}^mC_{ds}T_{ds}T_{ds}T_{ds}T_{ds}A_{ds}{}^mC_{es}A_{ks}T_{es}T_{ks}A_e$ | 39 | 2821 |
| 1198487 | 4605 | 4620 | 125630 | 125645 | TTAAGCACTTTTACAT | $T_{ks}T_{ks}A_{ds}A_{ds}G_{ds}{}^mC_{ds}A_{ds}{}^mC_{ds}T_{ds}T_{ds}T_{ds}T_{ds}A_{ks}{}^mC_{es}A_{ks}T_e$ | 62 | 2822 |
| 1198488 | 4795 | 4810 | 125820 | 125835 | GGAAGATCTGAAACTC | $G_{ks}G_{ks}A_{ds}A_{ds}G_{ds}A_{ds}T_{ds}{}^mC_{ds}T_{ds}G_{ds}A_{ds}A_{es}A_{ks}{}^mC_{es}T_{ks}{}^mC_e$ | 66 | 2823 |
| 1198489 | 4797 | 4812 | 125822 | 125837 | TTGGAAGATCTGAAAC | $T_{ks}T_{ks}G_{ds}G_{ds}A_{ds}A_{ds}G_{ds}A_{ds}T_{ds}{}^mC_{ds}T_{ds}G_{es}A_{ks}A_{es}A_{ks}{}^mC_e$ | 50 | 2824 |
| 1198490 | 4798 | 4813 | 125823 | 125838 | TTTGGAAGATCTGAAA | $T_{ks}T_{ks}T_{ds}G_{ds}G_{ds}A_{ds}A_{ds}G_{ds}A_{ds}T_{ds}{}^mC_{ds}T_{ds}G_{ks}A_{es}A_{ks}A_e$ | 53 | 2825 |
| 1198491 | 4799 | 4814 | 125824 | 125839 | CTTTGGAAGATCTGAA | $^mC_{ks}T_{ks}T_{ds}T_{ds}G_{ds}G_{ds}A_{ds}A_{ds}G_{ds}A_{ds}T_{ds}{}^mC_{es}T_{ks}G_{es}A_{ks}A_e$ | 22 | 2826 |
| 1198492 | 4800 | 4815 | 125825 | 125840 | GCTTTGGAAGATCTGA | $G_{ks}{}^mC_{ks}T_{ds}T_{ds}T_{ds}G_{ds}G_{ds}A_{ds}A_{ds}G_{ds}A_{ds}T_{es}{}^mC_{ks}T_{es}G_{ks}A_e$ | 15 | 2044 |
| 1198493 | 4801 | 4816 | 125826 | 125841 | TGCTTTGGAAGATCTG | $T_{ks}G_{ks}{}^mC_{ds}T_{ds}T_{ds}T_{ds}G_{ds}G_{ds}A_{ds}A_{ds}G_{ds}A_{es}T_{ks}{}^mC_{es}T_{ks}G_e$ | 28 | 2121 |
| 1198494 | 4802 | 4817 | 125827 | 125842 | GTGCTTTGGAAGATCT | $G_{ks}T_{ks}G_{ds}{}^mC_{ds}T_{ds}T_{ds}T_{ds}G_{ds}G_{ds}A_{ds}A_{ds}G_{es}A_{ks}T_{es}{}^mC_{ks}T_e$ | 15 | 2827 |
| 1198495 | 4803 | 4818 | 125828 | 125843 | AGTGCTTTGGAAGATC | $A_{ks}G_{ks}T_{ds}G_{ds}{}^mC_{ds}T_{ds}T_{ds}T_{ds}G_{ds}G_{ds}A_{ds}A_{es}G_{ks}A_{es}T_{ks}{}^mC_e$ | 22 | 2828 |
| 1198496 | 4805 | 4820 | 125830 | 125845 | ATAGTGCTTTGGAAGA | $A_{ks}T_{ks}A_{ds}G_{ds}T_{ds}G_{ds}{}^mC_{ds}T_{ds}T_{ds}T_{ds}G_{es}G_{es}A_{ks}A_{es}G_{ks}A_e$ | 46 | 2891 |
| 1198497 | N/A | N/A | 94729 | 94744 | AGGATGCATGGTTTTT | $A_{ks}G_{ks}G_{ds}A_{ds}T_{ds}G_{ds}{}^mC_{ds}A_{ds}T_{ds}G_{ds}G_{ds}T_{es}T_{ks}T_{es}T_{ks}T_e$ | 22 | 2830 |
| 1198498 | N/A | N/A | 94731 | 94746 | TTAGGATGCATGGTTT | $T_{ks}T_{ks}A_{ds}G_{ds}G_{ds}A_{ds}T_{ds}G_{ds}{}^mC_{ds}A_{ds}T_{ds}G_{es}G_{ks}T_{es}T_{ks}T_e$ | 39 | 2831 |
| 1198499 | N/A | N/A | 94732 | 94747 | TTTAGGATGCATGGTT | $T_{ks}T_{ks}T_{ds}A_{ds}G_{ds}G_{ds}A_{ds}T_{ds}G_{ds}{}^mC_{ds}A_{ds}T_{es}G_{ks}G_{es}T_{ks}T_e$ | 13 | 2832 |
| 1198500 | N/A | N/A | 94733 | 94748 | ATTTAGGATGCATGGT | $A_{ks}T_{ks}T_{ds}T_{ds}A_{ds}G_{ds}G_{ds}A_{ds}T_{ds}G_{ds}{}^mC_{ds}A_{es}T_{ks}G_{es}G_{ks}T_e$ | 17 | 2833 |
| 1198501 | N/A | N/A | 94734 | 94749 | GATTTAGGATGCATGG | $G_{ks}A_{ks}T_{ds}T_{ds}T_{ds}A_{ds}G_{ds}G_{ds}A_{ds}T_{ds}G_{ds}{}^mC_{es}A_{ks}T_{es}G_{ks}G_e$ | 5 | 2834 |
| 1198502 | N/A | N/A | 94735 | 94750 | AGATTTAGGATGCATG | $A_{ks}G_{ks}A_{ds}T_{ds}T_{ds}T_{ds}A_{ds}G_{ds}G_{ds}A_{ds}T_{ds}G_{es}{}^mC_{ks}A_{es}T_{ks}G_e$ | 16 | 2835 |
| 1198503 | N/A | N/A | 94736 | 94751 | CAGATTTAGGATGCAT | $^mC_{ks}A_{ks}G_{ds}A_{ds}T_{ds}T_{ds}T_{ds}A_{ds}G_{ds}G_{ds}A_{ds}T_{es}G_{ks}{}^mC_{es}A_{ks}T_e$ | 31 | 2836 |
| 1198504 | N/A | N/A | 94737 | 94752 | TCAGATTTAGGATGCA | $T_{ks}{}^mC_{ks}A_{ds}G_{ds}A_{ds}T_{ds}T_{ds}T_{ds}A_{ds}G_{ds}G_{ds}A_{es}T_{ks}G_{es}{}^mC_{ks}A_e$ | 15 | 2837 |
| 1198505 | N/A | N/A | 94739 | 94754 | ATTCAGATTTAGGATG | $A_{ks}T_{ks}T_{ds}{}^mC_{ds}A_{ds}G_{ds}A_{ds}T_{ds}T_{ds}T_{ds}A_{ds}G_{es}G_{ks}A_{es}T_{ks}G_e$ | 73 | 2838 |
| 1198506 | N/A | N/A | 115903 | 115918 | ATATGGTTTTGTGTGT | $A_{ks}T_{ks}A_{ds}T_{ds}G_{ds}G_{ds}T_{ds}T_{ds}T_{ds}T_{ds}G_{ds}T_{es}G_{ks}T_{es}G_{ks}T_e$ | 47 | 2839 |
| 1198507 | N/A | N/A | 115905 | 115920 | TTATATGGTTTTGTGT | $T_{ks}T_{ks}A_{ds}T_{ds}A_{ds}T_{ds}G_{ds}G_{ds}T_{ds}T_{ds}T_{ds}T_{ds}G_{ks}T_{es}G_{ks}T_e$ | 17 | 2840 |
| 1198508 | N/A | N/A | 115906 | 115921 | CTTATATGGTTTTGTG | $^mC_{ks}T_{ks}T_{ds}A_{ds}T_{ds}A_{ds}T_{ds}G_{ds}G_{ds}T_{ds}T_{ds}T_{es}T_{ks}G_{es}T_{ks}G_e$ | 22 | 2788 |
| 1198509 | N/A | N/A | 115907 | 115922 | TCTTATATGGTTTTGT | $T_{ks}{}^mC_{ks}T_{ds}T_{ds}A_{ds}T_{ds}A_{ds}T_{ds}G_{ds}G_{ds}T_{ds}T_{es}T_{ks}T_{es}G_{ks}T_e$ | 20 | 2841 |

TABLE 44-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198510 | N/A | N/A | 115908 | 115923 | CTCTTATATGGTTTTG | $^mC_{ks}T_{ds}{}^mC_{ds}T_{ds}T_{ds}A_{ds}T_{ds}A_{ds}T_{ds}G_{ds}G_{ds}T_{es}T_{es}T_{ks}G_e$ | 8 | 2842 |
| 1198511 | N/A | N/A | 115909 | 115924 | ACTCTTATATGGTTTT | $A_{ks}{}^mC_{ks}T_{ds}{}^mC_{ds}T_{ds}T_{ds}A_{ds}T_{ds}A_{ds}T_{ds}G_{ds}G_{es}T_{ks}T_{es}T_{ks}T_e$ | 53 | 2859 |
| 1198512 | N/A | N/A | 115910 | 115925 | AACTCTTATATGGTTT | $A_{ks}A_{ks}{}^mC_{ds}T_{ds}{}^mC_{ds}T_{ds}T_{ds}A_{ds}T_{ds}A_{ds}T_{ds}G_{es}G_{ks}T_{ks}T_e$ | 62 | 2860 |
| 1198513 | N/A | N/A | 115911 | 115926 | CAACTCTTATATGGTT | $^mC_{ks}A_{ks}A_{ds}{}^mC_{ds}T_{ds}{}^mC_{ds}T_{ds}T_{ds}A_{ds}T_{ds}A_{ds}T_{es}G_{ks}G_{es}T_{ks}T_e$ | 63 | 2861 |
| 1198514 | N/A | N/A | 115913 | 115928 | GACAACTCTTATATGG | $G_{ks}A_{ks}{}^mC_{ds}A_{ds}A_{ds}{}^mC_{ds}T_{ds}{}^mC_{ds}T_{ds}T_{ds}A_{ds}T_{es}A_{ks}T_{es}G_{ks}G_e$ | 53 | 2862 |
| 1198515 | N/A | N/A | 117325 | 117340 | ATTGCAATCTGTCGAA | $A_{ks}T_{ks}T_{ds}G_{ds}{}^mC_{ds}A_{ds}A_{ds}T_{ds}{}^mC_{ds}T_{ds}G_{ds}T_{es}{}^mC_{ks}T_{es}G_{ks}A_e$ | 44 | 2843 |
| 1198516 | N/A | N/A | 117327 | 117342 | ATATTGCAATCTGTCT | $A_{ks}T_{ks}A_{ds}T_{ds}T_{ds}G_{ds}{}^mC_{ds}A_{ds}A_{ds}T_{ds}{}^mC_{ds}T_{es}G_{ks}T_{es}{}^mC_{ks}T_e$ | 50 | 2844 |
| 1198517 | N/A | N/A | 117328 | 117343 | AATATTGCAATCTGTC | $A_{ks}A_{ks}T_{ds}A_{ds}T_{ds}T_{ds}G_{ds}{}^mC_{ds}A_{ds}A_{ds}T_{ds}{}^mC_{es}T_{ks}G_{es}T_{ks}{}^mC_e$ | 36 | 2845 |
| 1198518 | N/A | N/A | 117329 | 117344 | TAATATTGCAATCTGT | $T_{ks}A_{ks}A_{ds}T_{ds}A_{ds}T_{ds}T_{ds}G_{ds}{}^mC_{ds}A_{ds}A_{ds}T_{es}{}^mC_{ks}T_{es}G_{ks}T_e$ | 71 | 2846 |
| 1198519 | N/A | N/A | 117330 | 117345 | GTAATATTGCAATCTG | $G_{ks}T_{ks}A_{ds}A_{ds}T_{ds}A_{ds}T_{ds}T_{ds}G_{ds}{}^mC_{ds}A_{ds}A_{es}T_{ks}{}^mC_{es}T_{ks}G_e$ | 20 | 1404 |
| 1198520 | N/A | N/A | 117331 | 117346 | TGTAATATTGCAATCT | $T_{ks}G_{ks}T_{ds}A_{ds}A_{ds}T_{ds}A_{ds}T_{ds}T_{ds}G_{ds}{}^mC_{ds}A_{es}A_{ks}T_{es}{}^mC_{ks}T_e$ | 51 | 2847 |
| 1198521 | N/A | N/A | 117332 | 117347 | ATGTAATATTGCAATC | $A_{ks}T_{ks}G_{ds}T_{ds}A_{ds}A_{ds}T_{ds}A_{ds}T_{ds}T_{ds}G_{ds}{}^mC_{es}A_{ks}A_{es}T_{ks}{}^mC_e$ | 44 | 2848 |
| 1198522 | N/A | N/A | 117333 | 117348 | TATGTAATATTGCAAT | $T_{ks}A_{ks}T_{ds}G_{ds}T_{ds}A_{ds}A_{ds}T_{ds}A_{ds}T_{ds}T_{ds}G_{es}{}^mC_{ks}A_{es}A_{ks}T_e$ | 37 | 2849 |
| 1198523 | N/A | N/A | 117335 | 117350 | TTTATGTAATATTGCA | $T_{ks}T_{ks}T_{ds}A_{ds}T_{ds}G_{ds}T_{ds}A_{ds}A_{ds}T_{ds}A_{ds}T_{es}T_{ks}G_{es}{}^mC_{ks}A_e$ | 93 | 2850 |
| 1198524 | N/A | N/A | 117755 | 117770 | TGTATGTCAGAAGAGT | $T_{ks}G_{ks}T_{ds}A_{ds}T_{ds}G_{ds}T_{ds}{}^mC_{ds}A_{ds}G_{ds}A_{ds}A_{es}G_{ks}A_{es}G_{ks}T_e$ | 3 | 2863 |
| 1198525 | N/A | N/A | 117757 | 117772 | AGTGTATGTCAGAAGA | $A_{ks}G_{ks}T_{ds}G_{ds}T_{ds}A_{ds}T_{ds}G_{ds}T_{ds}{}^mC_{ds}A_{ds}G_{es}A_{ks}A_{es}G_{ks}A_e$ | 2 | 2864 |
| 1198526 | N/A | N/A | 117758 | 117773 | AAGTGTATGTCAGAAG | $A_{ks}A_{ks}G_{ds}T_{ds}G_{ds}T_{ds}A_{ds}T_{ds}G_{ds}T_{ds}{}^mC_{ds}A_{ds}G_{ks}A_{es}A_{ks}G_e$ | 2 | 2865 |
| 1198527 | N/A | N/A | 117759 | 117774 | AAAGTGTATGTCAGAA | $A_{ks}A_{ks}A_{ds}G_{ds}T_{ds}G_{ds}T_{ds}A_{ds}T_{ds}G_{ds}T_{ds}{}^mC_{es}A_{ks}G_{es}A_{ks}A_e$ | 5 | 2866 |
| 1198528 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{es}{}^mC_{es}A_{ks}G_{es}A_e$ | 14 | 2867 |
| 1198529 | N/A | N/A | 117761 | 117776 | TTAAAGTGTATGTCAG | $T_{ks}T_{ks}A_{ds}A_{ds}A_{ds}G_{ds}T_{ds}G_{ds}T_{ds}A_{ds}T_{ds}G_{es}T_{ks}{}^mC_{es}A_{ks}G_e$ | 17 | 2868 |
| 1198530 | N/A | N/A | 117762 | 117777 | TTTAAAGTGTATGTCA | $T_{ks}T_{ks}T_{ds}A_{ds}A_{ds}A_{ds}G_{ds}T_{ds}G_{ds}T_{ds}A_{ds}T_{es}G_{ks}T_{es}{}^mC_{ks}A_e$ | 29 | 2869 |
| 1198531 | N/A | N/A | 117763 | 117778 | CTTTAAAGTGTATGTC | $^mC_{ks}T_{ks}T_{ds}T_{ds}A_{ds}A_{ds}A_{ds}G_{ds}T_{ds}G_{ds}T_{ds}A_{es}T_{ks}G_{es}T_{ks}{}^mC_e$ | 21 | 1634 |
| 1198532 | N/A | N/A | 117765 | 117780 | AACTTTAAAGTGTATG | $A_{ks}A_{ks}{}^mC_{ds}T_{ds}T_{ds}T_{ds}A_{ds}A_{ds}A_{ds}G_{ds}T_{es}G_{es}T_{ks}A_{es}T_{ks}G_e$ | 36 | 2870 |
| 1198533 | N/A | N/A | 119667 | 119682 | TAAGGTTTCCCAGATT | $T_{ks}A_{ks}A_{ds}G_{ds}G_{ds}T_{ds}T_{ds}T_{ds}{}^mC_{ds}{}^mC_{ds}{}^mC_{ds}A_{es}G_{ks}A_{es}T_{ks}T_e$ | 35 | 2851 |
| 1198534 | N/A | N/A | 119669 | 119684 | AGTAAGGTTTCCCAGA | $A_{ks}G_{ks}T_{ds}A_{ds}A_{ds}G_{ds}G_{ds}T_{ds}T_{ds}T_{ds}{}^mC_{es}{}^mC_{es}{}^mC_{ks}A_{es}G_{ks}A_e$ | 30 | 2852 |
| 1198535 | N/A | N/A | 119670 | 119685 | AAGTAAGGTTTCCCAG | $A_{ks}A_{ks}G_{ds}T_{ds}A_{ds}A_{ds}G_{ds}G_{ds}T_{ds}T_{ds}T_{ds}{}^mC_{es}{}^mC_{ks}{}^mC_{es}A_{ks}G_e$ | 35 | 2853 |
| 1198536 | N/A | N/A | 119671 | 119686 | TAAGTAAGGTTTCCCA | $T_{ks}A_{ks}A_{ds}G_{ds}T_{ds}A_{ds}A_{ds}G_{ds}G_{ds}T_{ds}T_{ds}T_{es}{}^mC_{ks}{}^mC_{es}{}^mC_{ks}A_e$ | 20 | 2854 |
| 1198537 | N/A | N/A | 119672 | 119687 | CTAAGTAAGGTTTCCC | $^mC_{ks}T_{ks}A_{ds}A_{ds}G_{ds}T_{ds}A_{ds}A_{ds}G_{ds}G_{ds}T_{ds}T_{es}T_{ks}{}^mC_{es}{}^mC_{ks}{}^mC_e$ | 24 | 1101 |
| 1198538 | N/A | N/A | 119673 | 119688 | ACTAAGTAAGGTTTCC | $A_{ks}{}^mC_{ks}T_{ds}A_{ds}A_{ds}G_{ds}T_{ds}A_{ds}A_{ds}G_{ds}G_{ds}T_{es}T_{es}T_{es}{}^mC_{ks}{}^mC_e$ | 29 | 2855 |
| 1198539 | N/A | N/A | 119674 | 119689 | GACTAAGTAAGGTTTC | $G_{ks}A_{ks}{}^mC_{ds}T_{ds}A_{ds}A_{ds}G_{ds}T_{ds}A_{ds}A_{ds}G_{ds}G_{es}T_{ks}T_{es}T_{ks}{}^mC_e$ | 54 | 2856 |
| 1198540 | N/A | N/A | 119675 | 119690 | AGACTAAGTAAGGTTT | $A_{ks}G_{ks}A_{ds}{}^mC_{ds}T_{ds}A_{ds}A_{ds}G_{ds}T_{ds}A_{ds}A_{ds}G_{es}G_{ks}T_{es}T_{ks}T_e$ | 51 | 2857 |
| 1198541 | N/A | N/A | 119677 | 119692 | TTAGACTAAGTAAGGT | $T_{ks}T_{ks}A_{ds}G_{ds}A_{ds}{}^mC_{ds}T_{ds}A_{ds}A_{ds}G_{ds}T_{ds}A_{es}A_{ks}G_{es}G_{ks}T_e$ | 34 | 2858 |
| 1198890 | 2524 | 2539 | 123549 | 123564 | TGTCTCATGCCTTATA | $T_{ks}G_{ks}T_{ds}{}^mC_{ds}T_{ds}{}^mC_{ds}A_{ds}T_{ds}G_{ds}{}^mC_{ds}{}^mC_{ds}T_{ks}T_{ds}A_{ks}T_{ds}A_k$ | 19 | 2803 |
| 1198891 | 2526 | 2541 | 123551 | 123566 | ATTGTCTCATGCCTTA | $A_{ks}T_{ks}T_{ds}G_{ds}T_{ds}{}^mC_{ds}T_{ds}{}^mC_{ds}A_{ds}T_{ds}G_{ds}{}^mC_{ds}{}^mC_{ks}T_{ds}T_{ks}A_k$ | 18 | 2804 |
| 1198892 | 2527 | 2542 | 123552 | 123567 | AATTGTCTCATGCCTT | $A_{ks}A_{ks}T_{ds}T_{ds}G_{ds}T_{ds}{}^mC_{ds}T_{ds}{}^mC_{ds}A_{ds}T_{ds}G_{ks}{}^mC_{ds}{}^mC_{ks}T_{ds}T_k$ | 24 | 2805 |
| 1198899 | 2560 | 2575 | 123585 | 123600 | AGTATGTGGCAATAAT | $A_{ks}G_{ks}T_{ds}A_{ds}T_{ds}G_{ds}T_{ds}G_{ds}G_{ds}{}^mC_{ds}A_{ds}A_{ks}T_{ds}A_{ks}A_{ds}T_k$ | 75 | 2809 |

TABLE 44-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198900 | 2562 | 2577 | 123587 | 123602 | AGAGTATGTGGCAATA | $A_{ks}G_{ks}A_{ds}G_{ds}T_{ds}A_{ds}T_{ds}G_{ds}T_{ds}G_{ds}G_{ds}{}^mC_{ks}A_{ds}A_{ks}T_{ds}A_k$ | 11 | 2810 |
| 1198901 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}G_{ks}{}^mC_{ds}A_{ks}A_{ds}T_k$ | 28 | 2811 |
| 1198902 | 2564 | 2579 | 123589 | 123604 | TTAGAGTATGTGGCAA | $T_{ks}T_{ks}A_{ds}G_{ds}A_{ds}G_{ds}T_{ds}A_{ds}T_{ds}G_{ds}T_{ds}G_{ks}G_{ds}{}^mC_{ks}A_{ds}A_k$ | 13 | 963 |
| 1198903 | 2565 | 2580 | 123590 | 123605 | ATTAGAGTATGTGGCA | $A_{ks}T_{ks}T_{ds}A_{ds}G_{ds}A_{ds}G_{ds}T_{ds}A_{ds}T_{ds}G_{ds}T_{ks}G_{ds}G_{ks}{}^mC_{ds}A_k$ | 24 | 810 |
| 1198904 | 2566 | 2581 | 123591 | 123606 | TATTAGAGTATGTGGC | $T_{ks}A_{ks}T_{ds}T_{ds}A_{ds}G_{ds}A_{ds}G_{ds}T_{ds}A_{ds}T_{ds}G_{ks}T_{ds}G_{ks}G_{ds}{}^mC_k$ | 12 | 2812 |
| 1198905 | 2567 | 2582 | 123592 | 123607 | ATATTAGAGTATGTGG | $A_{ks}T_{ks}A_{ds}T_{ds}T_{ds}A_{ds}G_{ds}A_{ds}G_{ds}T_{ds}A_{ds}T_{ks}G_{ds}T_{ks}G_{ds}G_k$ | 5 | 2813 |
| 1198906 | 2568 | 2583 | 123593 | 123608 | TATATTAGAGTATGTG | $T_{ks}A_{ks}T_{ds}A_{ds}T_{ds}T_{ds}A_{ds}G_{ds}A_{ds}G_{ds}T_{ds}A_{ks}T_{ds}G_{ks}T_{ds}G_k$ | 56 | 2814 |
| 1198907 | 2570 | 2585 | 123595 | 123610 | TCTATATTAGAGTATG | $T_{ks}{}^mC_{ks}T_{ds}A_{ds}T_{ds}A_{ds}T_{ds}T_{ds}A_{ds}G_{ds}A_{ds}G_{ks}T_{ds}A_{ks}T_{ds}G_k$ | 74 | 887 |

TABLE 45

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}{}^mC_{ds}A_{ds}T_{ds}A_{ds}G_{ds}{}^mC_{ds}T_{ks}T_{ks}A_k$ | 28 | 52 |
| 958499 | 2565 | 2580 | 123590 | 123605 | ATTAGAGTATGTGGCA | $A_{ks}T_{ks}T_{ks}A_{ds}A_{ds}G_{ds}T_{ds}A_{ds}T_{ds}G_{ds}T_{ds}G_{ds}G_{ds}{}^mC_{ks}A_k$ | 15 | 810 |
| 1074461 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 9 | 2800 |
| 1095491 | 4443 | 4458 | 125468 | 125483 | ACTGAGGTATAACTGG | $A_{ks}{}^mC_{ks}T_{ds}G_{ds}A_{ds}G_{ds}G_{ds}T_{ds}A_{ds}T_{ds}A_{ds}A_{ks}{}^mC_{ds}T_{ks}G_{ds}G_k$ | 65 | 392 |
| 1095509 | 4441 | 4456 | 125466 | 125481 | TGAGGTATAACTGGGC | $T_{ks}G_{ks}A_{ds}G_{ds}G_{ds}T_{ds}A_{ds}T_{ds}A_{ds}A_{ds}{}^mC_{ds}T_{ks}G_{ds}G_{ks}G_{ds}{}^mC_k$ | 29 | 1580 |
| 1095510 | 4442 | 4457 | 125467 | 125482 | CTGAGGTATAACTGGG | ${}^mC_{ks}T_{ks}G_{ds}A_{ds}G_{ds}G_{ds}T_{ds}A_{ds}T_{ds}A_{ds}A_{ds}{}^mC_{ds}T_{ds}G_{ks}G_{ds}G_k$ | 35 | 2801 |
| 1095511 | 4444 | 4459 | 125469 | 125484 | CACTGAGGTATAACTG | ${}^mC_{ks}A_{ks}{}^mC_{ds}T_{ds}G_{ds}A_{ds}G_{ds}G_{ds}T_{ds}A_{ds}T_{ds}A_{ks}A_{ds}{}^mC_{ks}T_{ds}G_k$ | 46 | 2802 |
| 1198893 | 2528 | 2543 | 123553 | 123568 | AAATTGTCTCATGCCT | $A_{ks}A_{ks}A_{ds}T_{ds}T_{ds}G_{ds}T_{ds}{}^mC_{ds}T_{ds}{}^mC_{ds}A_{ds}T_{ks}G_{ds}{}^mC_{ks}{}^mC_{ds}T_k$ | 58 | 443 |
| 1198894 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{ks}T_{ds}G_{ks}{}^mC_{ds}{}^mC_k$ | 57 | 2800 |
| 1198895 | 2530 | 2545 | 123555 | 123570 | GGAAATTGTCTCATGC | $G_{ks}G_{ks}A_{ds}A_{ds}A_{ds}T_{ds}T_{ds}G_{ds}T_{ds}{}^mC_{ds}T_{ds}{}^mC_{ds}A_{ks}T_{ds}G_{ds}{}^mC_k$ | 22 | 2806 |
| 1198896 | 2531 | 2546 | 123556 | 123571 | TGGAAATTGTCTCATG | $T_{ks}G_{ks}G_{ds}A_{ds}A_{ds}A_{ds}T_{ds}T_{ds}G_{ds}T_{ds}{}^mC_{ds}T_{ks}{}^mC_{ds}A_{ks}T_{ds}G_k$ | 59 | 2807 |
| 1198897 | 2532 | 2547 | 123557 | 123572 | ATGGAAATTGTCTCAT | $A_{ks}T_{ks}G_{ds}G_{ds}A_{ds}A_{ds}A_{ds}T_{ds}T_{ds}G_{ds}T_{ds}{}^mC_{ks}T_{ds}{}^mC_{ks}A_{ds}T_k$ | 61 | 2808 |
| 1198898 | 2534 | 2549 | 123559 | 123574 | ATATGGAAATTGTCTC | $A_{ks}T_{ks}A_{ds}T_{ds}G_{ds}G_{ds}A_{ds}A_{ds}A_{ds}T_{ds}T_{ds}G_{ks}T_{ds}{}^mC_{ks}T_{ds}{}^mC_k$ | 53 | 656 |
| 1198908 | 4436 | 4451 | 125461 | 125476 | TATAACTGGGCAAATT | $T_{ks}A_{ks}T_{ds}A_{ds}A_{ds}{}^mC_{ds}T_{ds}G_{ds}G_{ds}G_{ds}{}^mC_{ds}A_{ks}A_{ds}A_{ks}T_{ds}T_k$ | 124 | 2815 |
| 1198909 | 4438 | 4453 | 125463 | 125478 | GGTATAACTGGGCAAA | $G_{ks}G_{ks}T_{ds}A_{ds}T_{ds}A_{ds}A_{ds}{}^mC_{ds}T_{ds}G_{ds}G_{ds}G_{ks}{}^mC_{ds}A_{ks}A_{ds}A_k$ | 56 | 1427 |
| 1198910 | 4439 | 4454 | 125464 | 125479 | AGGTATAACTGGGCAA | $A_{ks}G_{ks}G_{ds}T_{ds}A_{ds}T_{ds}A_{ds}A_{ds}{}^mC_{ds}T_{ds}G_{ds}G_{ks}G_{ds}{}^mC_{ks}A_{ds}A_k$ | 40 | 905 |
| 1198911 | 4440 | 4455 | 125465 | 125480 | GAGGTATAACTGGGCA | $G_{ks}A_{ks}G_{ds}G_{ds}T_{ds}A_{ds}T_{ds}A_{ds}A_{ds}{}^mC_{ds}T_{ds}G_{ds}G_{ks}G_{ds}{}^mC_{ds}A_k$ | 26 | 1503 |
| 1198912 | 4446 | 4461 | 125471 | 125486 | AACACTGAGGTATAAC | $A_{ks}A_{ks}{}^mC_{ds}A_{ds}{}^mC_{ds}T_{ds}G_{ds}A_{ds}G_{ds}G_{ds}T_{ds}A_{ks}T_{ds}A_{ks}A_{ds}{}^mC_k$ | 78 | 2816 |
| 1198913 | 4595 | 4610 | 125620 | 125635 | TTACATTAGGAACAAG | $T_{ks}T_{ks}A_{ds}{}^mC_{ds}A_{ds}T_{ds}T_{ds}A_{ds}G_{ds}G_{ds}A_{ds}A_{ks}{}^mC_{ds}A_{ks}A_{ds}G_k$ | 86 | 2817 |
| 1198914 | 4597 | 4612 | 125622 | 125637 | TTTTACATTAGGAACA | $T_{ks}T_{ks}T_{ds}T_{ds}A_{ds}{}^mC_{ds}A_{ds}T_{ds}T_{ds}A_{ds}G_{ds}G_{ks}A_{ds}A_{ks}{}^mC_{ds}A_k$ | 68 | 2818 |
| 1198915 | 4598 | 4613 | 125623 | 125638 | CTTTTACATTAGGAAC | ${}^mC_{ks}T_{ks}T_{ds}T_{ds}T_{ds}A_{ds}{}^mC_{ds}A_{ds}T_{ds}T_{ds}A_{ds}G_{ks}G_{ds}A_{ks}A_{ds}{}^mC_k$ | 37 | 1124 |

TABLE 45-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198916 | 4599 | 4614 | 125624 | 125639 | ACTTTTACATTAGGAA | $A_{ks}{}^mC_{ks}T_{ds}T_{ds}T_{ds}T_{ds}A_{ds}{}^mC_{ds}A_{ds}T_{ds}T_{ds}A_{ks}G_{ds}G_{ks}A_{ds}A_k$ | 59 | 2819 |
| 1198917 | 4600 | 4615 | 125625 | 125640 | CACTTTTACATTAGGA | ${}^mC_{ks}A_{ks}{}^mC_{ds}T_{ds}T_{ds}T_{ds}T_{ds}A_{ds}{}^mC_{ds}A_{ds}T_{ds}T_{ks}A_{ds}G_{ks}G_{ds}A_k$ | 21 | 1200 |
| 1198918 | 4601 | 4616 | 125626 | 125641 | GCACTTTTACATTAGG | $G_{ks}{}^mC_{ks}A_{ds}{}^mC_{ds}T_{ds}T_{ds}T_{ds}T_{ds}A_{ds}{}^m{}^mC_{ds}A_{ds}T_{ks}T_{ds}A_{ks}G_{ds}G_k$ | 27 | 1276 |
| 1198919 | 4602 | 4617 | 125627 | 125642 | AGCACTTTTACATTAG | $A_{ks}G^{m}C_{ds}A_{ds}{}^mC_{ds}T_{ds}T_{ds}T_{ds}T_{ds}A_{ds}{}^mC_{ds}A_{ks}T_{ds}T_{ks}A_{ds}G_k$ | 60 | 2820 |
| 1198920 | 4603 | 4618 | 125628 | 125643 | AAGCACTTTTACATTA | $A_{ks}A_{ks}G_{ds}{}^mC_{ds}A_{ds}{}^mC_{ds}T_{ds}T_{ds}T_{ds}T_{ds}A_{ds}{}^mC_{ks}A_{ds}T_{ks}T_{ds}A_k$ | 54 | 2821 |
| 1198921 | 4605 | 4620 | 125630 | 125645 | TTAAGCACTTTTACAT | $T_{ks}T_{ks}A_{ds}A_{ds}G_{ds}{}^mC_{ds}A_{ds}{}^mC_{ds}T_{ds}T_{ds}T_{ks}A_{ds}{}^mC_{ks}A_{ds}T_k$ | 89 | 2822 |
| 1198922 | 4795 | 4810 | 125820 | 125835 | GGAAGATCTGAAACTC | $G_{ks}G_{ks}A_{ds}A_{ds}G_{ds}A_{ds}T_{ds}{}^mC_{ds}T_{ds}G_{ds}A_{ks}A_{ds}{}^mC_{ks}T_{ds}{}^mC_k$ | 59 | 2823 |
| 1198923 | 4797 | 4812 | 125822 | 125837 | TTGGAAGATCTGAAAC | $T_{ks}T_{ks}G_{ds}G_{ds}A_{ds}A_{ds}G_{ds}A_{ds}T_{ds}{}^mC_{ds}T_{ds}G_{ks}A_{ds}A_{ks}A_{ds}{}^mC_k$ | 73 | 2824 |
| 1198924 | 4798 | 4813 | 125823 | 125838 | TTTGGAAGATCTGAAA | $T_{ks}T_{ks}T_{ds}G_{ds}G_{ds}A_{ds}A_{ds}G_{ds}A_{ds}T_{ds}{}^mC_{ds}T_{ks}G_{ds}A_{ks}A_{ds}A_k$ | 75 | 2825 |
| 1198925 | 4799 | 4814 | 125824 | 125839 | CTTTGGAAGATCTGAA | ${}^mC_{ks}T_{ks}T_{ks}T_{ds}G_{ds}G_{ds}A_{ds}A_{ds}G_{ds}A_{ds}T_{ds}{}^mC_{ks}T_{ds}G_{ks}A_{ds}A_k$ | 52 | 2826 |
| 1198926 | 4800 | 4815 | 125825 | 125840 | GCTTTGGAAGATCTGA | $G_{ks}{}^mC_{ks}T_{ds}T_{ds}T_{ds}G_{ds}G_{ds}A_{ds}A_{ds}G_{ds}A_{ds}T_{ks}{}^mC_{ds}T_{ks}G_{ds}A_k$ | 45 | 2044 |
| 1198927 | 4801 | 4816 | 125826 | 125841 | TGCTTTGGAAGATCTG | $T_{ks}G_{ks}{}^mC_{ds}T_{ds}T_{ds}T_{ds}G_{ds}G_{ds}A_{ds}A_{ds}G_{ds}A_{ks}T_{ds}{}^mC_{ks}T_{ds}G_k$ | 50 | 2121 |
| 1198928 | 4802 | 4817 | 125827 | 125842 | GTGCTTTGGAAGATCT | $G_{ks}T_{ks}G_{ds}{}^mC_{ds}T_{ds}T_{ds}T_{ds}G_{ds}G_{ds}A_{ds}A_{ds}G_{ks}A_{ds}T_{ks}{}^mC_{ds}T_k$ | 28 | 2827 |
| 1198929 | 4803 | 4818 | 125828 | 125843 | AGTGCTTTGGAAGATC | $A_{ks}G_{ks}T_{ds}G_{ds}{}^mC_{ds}T_{ds}T_{ds}T_{ds}G_{ds}G_{ds}A_{ds}A_{ks}G_{ds}A_{ks}T_{ds}{}^mC_k$ | 43 | 2828 |
| 1198930 | 4805 | 4820 | 125830 | 125845 | ATAGTGCTTTGGAAGA | $A_{ks}T_{ks}A_{ds}G_{ds}T_{ds}G_{ds}{}^mC_{ds}T_{ds}T_{ds}T_{ds}G_{ks}G_{ds}A_{ds}A_{ks}G_{ds}A_k$ | 68 | 2829 |
| 1198931 | N/A | N/A | 94729 | 94744 | AGGATGCATGGTTTTT | $A_{ks}G_{ks}G_{ds}A_{ds}T_{ds}G_{ds}{}^mC_{ds}A_{ds}T_{ds}G_{ds}G_{ds}T_{ks}T_{ds}T_{ks}T_{ds}T_k$ | 47 | 2830 |
| 1198932 | N/A | N/A | 94731 | 94746 | TTAGGATGCATGGTTT | $T_{ks}T_{ks}A_{ds}G_{ds}G_{ds}A_{ds}T_{ds}G_{ds}{}^mC_{ds}A_{ds}T_{ds}G_{ks}G_{ds}T_{ks}T_{ds}T_k$ | 35 | 2831 |
| 1198933 | N/A | N/A | 94732 | 94747 | TTTAGGATGCATGGTT | $T_{ks}T_{ks}T_{ds}A_{ds}G_{ds}G_{ds}A_{ds}T_{ds}G_{ds}{}^mC_{ds}A_{ds}T_{ks}G_{ds}G_{ks}T_{ds}T_k$ | 69 | 2832 |
| 1198934 | N/A | N/A | 94733 | 94748 | ATTTAGGATGCATGGT | $A_{ks}T_{ks}T_{ds}T_{ds}A_{ds}G_{ds}G_{ds}A_{ds}T_{ds}G_{ds}{}^mC_{ds}A_{ks}T_{ds}G_{ks}G_{ds}T_k$ | 56 | 2833 |
| 1198935 | N/A | N/A | 94734 | 94749 | GATTTAGGATGCATGG | $G_{ks}A_{ks}T_{ds}T_{ds}T_{ds}A_{ds}G_{ds}G_{ds}A_{ds}T_{ds}G_{ds}{}^mC_{ks}A_{ds}T_{ks}G_{ds}G_k$ | 18 | 2834 |
| 1198936 | N/A | N/A | 94735 | 94750 | AGATTTAGGATGCATG | $A_{ks}G_{ks}A_{ds}T_{ds}T_{ds}T_{ds}A_{ds}G_{ds}G_{ds}A_{ds}T_{ds}G_{ks}{}^mC_{ds}A_{ks}T_{ds}G_k$ | 38 | 2835 |
| 1198937 | N/A | N/A | 94736 | 94751 | CAGATTTAGGATGCAT | ${}^mC_{ks}A_{ks}G_{ds}A_{ds}T_{ds}T_{ds}T_{ds}A_{ds}G_{ds}G_{ds}A_{ds}T_{ks}G_{ds}{}^mC_{ks}A_{ds}T_k$ | 48 | 2836 |
| 1198938 | N/A | N/A | 94737 | 94752 | TCAGATTTAGGATGCA | $T_{ks}{}^mC_{ks}A_{ds}G_{ds}A_{ds}T_{ds}T_{ds}T_{ds}A_{ds}G_{ds}G_{ds}A_{ks}T_{ks}G_{ds}{}^mC_{ds}A_k$ | 59 | 2837 |
| 1198939 | N/A | N/A | 94739 | 94754 | ATTCAGATTTAGGATG | $A_{ks}T_{ks}T_{ds}{}^mC_{ds}A_{ds}G_{ds}A_{ds}T_{ds}T_{ds}T_{ds}A_{ds}G_{ks}G_{ds}A_{ks}T_{ds}G_k$ | 102 | 28388 |
| 1198940 | N/A | N/A | 115903 | 115918 | ATATGGTTTTGTGTGT | $A_{ks}T_{ks}A_{ds}T_{ds}G_{ds}G_{ds}T_{ds}T_{ds}T_{ds}T_{ds}G_{ds}T_{ks}G_{ds}T_{ks}G_{ds}T_k$ | 51 | 2881 |
| 1198941 | N/A | N/A | 115905 | 115920 | TTATATGGTTTTGTGT | $T_{ks}T_{ks}A_{ds}T_{ds}A_{ds}T_{ds}G_{ds}G_{ds}T_{ds}T_{ds}T_{ds}T_{ks}G_{ds}T_{ks}G_{ds}T_k$ | 35 | 2840 |
| 1198942 | N/A | N/A | 115906 | 115921 | CTTATATGGTTTTGTG | ${}^mC_{ks}T_{ks}T_{ds}A_{ds}T_{ds}A_{ds}T_{ds}G_{ds}G_{ds}T_{ds}T_{ks}T_{ds}T_{ds}G_{ks}T_{ds}G_k$ | 42 | 2788 |
| 1198943 | N/A | N/A | 115907 | 115922 | TCTTATATGGTTTTGT | $T_{ks}{}^mC_{ks}T_{ds}T_{ds}A_{ds}T_{ds}A_{ds}T_{ds}G_{ds}G_{ds}T_{ks}T_{ds}T_{ks}T_{ds}G_{ds}T_k$ | 31 | 2841 |
| 1198944 | N/A | N/A | 115908 | 115923 | CTCTTATATGGTTTTG | ${}^mC_{ks}T_{ks}{}^mC_{ds}T_{ds}T_{ds}A_{ds}T_{ds}A_{ds}T_{ds}G_{ds}G_{ks}T_{ds}T_{ks}T_{ds}T_{ds}G_k$ | 34 | 2842 |
| 1198945 | N/A | N/A | 115909 | 115924 | ACTCTTATATGGTTTT | $A_{ks}{}^mC_{ks}T_{ds}{}^mC_{ds}T_{ds}T_{ds}A_{ds}T_{ds}A_{ds}T_{ds}G_{ds}G_{ks}T_{ds}T_{ks}T_{ds}T_k$ | 48 | 2859 |
| 1198946 | N/A | N/A | 115910 | 115925 | AACTCTTATATGGTTT | $A_{ks}A_{ks}{}^mC_{ds}T_{ds}{}^mC_{ds}T_{ds}T_{ds}A_{ds}T_{ds}A_{ds}T_{ds}G_{ks}G_{ds}T_{ks}T_{ds}T_k$ | 72 | 2860 |
| 1198947 | N/A | N/A | 115911 | 115926 | CAACTCTTATATGGTT | ${}^mC_{ks}A_{ks}A_{ds}{}^mC_{ds}T_{ds}{}^mC_{ds}T_{ds}T_{ds}A_{ds}T_{ds}A_{ds}T_{ds}G_{ds}G_{ks}T_{ds}T_k$ | 88 | 2861 |
| 1198948 | N/A | N/A | 115913 | 115928 | GACAACTCTTATATGG | $G_{ks}A_{ks}{}^mC_{ds}A_{ds}A_{ds}{}^mC_{ds}T_{ds}{}^mC_{ds}T_{ds}T_{ds}A_{ks}T_{ds}A_{ks}T_{ds}G_{ds}G_k$ | 96 | 2862 |
| 1198949 | N/A | N/A | 117325 | 117340 | ATTGCAATCTGTCTGA | $A_{ks}T_{ks}T_{ds}G_{ds}{}^mC_{ds}A_{ds}A_{ds}T_{ds}{}^mC_{ds}T_{ds}G_{ds}T_{ks}{}^mC_{ds}T_{ks}G_{ds}A_k$ | 61 | 2843 |
| 1198950 | N/A | N/A | 117327 | 117342 | ATATTGCAATCTGTCT | $A_{ks}T_{ks}A_{ds}T_{ds}T_{ds}G_{ds}{}^mC_{ds}A_{ds}A_{ds}T_{ds}{}^mC_{ks}T_{ds}G_{ks}T_{ds}{}^mC_{ds}T_k$ | 85 | 2844 |
| 1198951 | N/A | N/A | 117328 | 117343 | AATATTGCAATCTGTC | $A_{ks}A_{ks}T_{ds}A_{ds}T_{ds}T_{ds}G_{ds}{}^mC_{ds}A_{ds}A_{ds}T_{ds}{}^mC_{ks}T_{ds}G_{ks}T_{ds}{}^mC_k$ | 81 | 2845 |

TABLE 45-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 (% UTC) | SEQ ID NO |
|---|---|---|---|---|---|---|---|---|
| 1198952 | N/A | N/A | 117329 | 117344 | TAATATTGCAATCTGT | $T_{ks}A_{ks}A_{ds}T_{ds}A_{ds}T_{ds}T_{ds}G_{ds}{}^{m}C_{ds}A_{ds}A_{ks}T_{ks}{}^{m}C_{ds}T_{ks}G_{ds}T_{k}$ | 77 | 2846 |
| 1198953 | N/A | N/A | 117330 | 117345 | GTAATATTGCAATCTG | $G_{ks}T_{ks}A_{ds}A_{ds}T_{ds}A_{ds}T_{ds}T_{ds}G_{ds}{}^{m}C_{ds}A_{ds}A_{ks}T_{ds}{}^{m}C_{ks}T_{ds}G_{k}$ | 58 | 1404 |
| 1198954 | N/A | N/A | 117331 | 117346 | TGTAATATTGCAATCT | $T_{ks}G_{ks}T_{ds}A_{ds}A_{ds}T_{ds}A_{ds}T_{ds}T_{ds}G_{ds}{}^{m}C_{ds}A_{ds}A_{ks}T_{ks}{}^{m}C_{ds}T_{k}$ | 94 | 2847 |
| 1198955 | N/A | N/A | 117332 | 117347 | ATGTAATATTGCAATC | $A_{ks}T_{ks}G_{ds}T_{ds}A_{ds}A_{ds}T_{ds}A_{ds}T_{ds}T_{ds}G_{ds}{}^{m}C_{ds}A_{ds}A_{ks}T_{ds}{}^{m}C_{k}$ | 92 | 2848 |
| 1198956 | N/A | N/A | 117333 | 117348 | TATGTAATATTGCAAT | $T_{ks}A_{ks}T_{ds}G_{ds}T_{ds}A_{ds}A_{ds}T_{ds}A_{ds}T_{ds}T_{ds}G_{ks}{}^{m}C_{ds}A_{ks}A_{ds}T_{k}$ | 76 | 2849 |
| 1198957 | N/A | N/A | 117335 | 117350 | TTTATGTAATATTGCA | $T_{ks}T_{ks}T_{ds}A_{ds}T_{ds}G_{ds}T_{ds}A_{ds}A_{ds}T_{ds}A_{ds}T_{ks}T_{ds}G_{ks}{}^{m}C_{ds}A_{k}$ | 81 | 2850 |
| 1198958 | N/A | N/A | 117755 | 117770 | TGTATGTCAGAAGAGT | $T_{ks}G_{ks}T_{ds}A_{ds}T_{ds}G_{ds}T_{ds}{}^{m}C_{ds}A_{ds}G_{ds}A_{ks}G_{ds}A_{ks}G_{ds}T_{k}$ | 12 | 2863 |
| 1198959 | N/A | N/A | 117757 | 117772 | AGTGTATGTCAGAAGA | $A_{ks}G_{ks}T_{ds}G_{ds}T_{ds}A_{ds}T_{ds}G_{ds}T_{ds}{}^{m}C_{ds}A_{ds}G_{ds}A_{ks}A_{ks}G_{ds}A_{k}$ | 8 | 2864 |
| 1198960 | N/A | N/A | 117758 | 117773 | AAGTGTATGTCAGAAG | $A_{ks}A_{ks}G_{ds}T_{ds}G_{ds}T_{ds}A_{ds}T_{ds}G_{ds}T_{ds}{}^{m}C_{ds}A_{ds}G_{ks}A_{ds}A_{ds}G_{k}$ | 6 | 2865 |
| 1198961 | N/A | N/A | 117759 | 117774 | AAAGTGTATGTCAGAA | $A_{ks}A_{ks}A_{ds}G_{ds}T_{ds}G_{ds}T_{ds}A_{ds}T_{ds}G_{ds}T_{ds}{}^{m}C_{ds}A_{ds}G_{ks}A_{ds}A_{k}$ | 12 | 2866 |
| 1198962 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{ks}{}^{m}C_{ds}A_{ks}G_{ds}A_{k}$ | 52 | 2867 |
| 1198963 | N/A | N/A | 117761 | 117776 | TTAAAGTGTATGTCAG | $T_{ks}T_{ks}A_{ds}A_{ds}A_{ds}G_{ds}T_{ds}G_{ds}T_{ds}A_{ds}T_{ds}G_{ks}T_{ds}{}^{m}C_{ks}A_{ds}G_{k}$ | 27 | 2868 |
| 1198964 | N/A | N/A | 117762 | 117777 | TTTAAAGTGTATGTCA | $T_{ks}T_{ks}T_{ds}A_{ds}A_{ds}A_{ds}G_{ds}T_{ds}G_{ds}T_{ds}A_{ds}T_{ks}G_{ds}T_{ks}{}^{m}C_{ds}A_{k}$ | 59 | 2869 |
| 1198965 | N/A | N/A | 117763 | 117778 | CTTTAAAGTGTATGTC | ${}^{m}C_{ks}T_{ks}T_{ds}T_{ds}A_{ds}A_{ds}A_{ds}G_{ds}T_{ds}G_{ds}T_{ds}A_{ks}T_{ds}G_{ks}T_{ds}{}^{m}C_{k}$ | 95 | 1634 |
| 1198967 | N/A | N/A | 119667 | 119682 | TAAGGTTTCCCAGATT | $T_{ks}A_{ks}A_{ds}G_{ds}G_{ds}T_{ds}T_{ds}T_{ds}{}^{m}C_{ds}{}^{m}C_{ds}{}^{m}C_{ds}A_{ks}G_{ds}A_{ks}T_{ds}T_{k}$ | 65 | 2851 |
| 1198968 | N/A | N/A | 119669 | 119684 | AGTAAGGTTTCCCAGA | $A_{ks}G_{ks}T_{ds}A_{ds}A_{ds}G_{ds}G_{ds}T_{ds}T_{ds}T_{ds}{}^{m}C_{ds}{}^{m}C_{ks}{}^{m}C_{ds}A_{ks}G_{ds}A_{k}$ | 57 | 2852 |
| 1198969 | N/A | N/A | 119670 | 119685 | AAGTAAGGTTTCCCAG | $A_{ks}A_{ks}G_{ds}T_{ds}A_{ds}A_{ds}G_{ds}G_{ds}T_{ds}T_{ds}T_{ds}{}^{m}C_{ks}{}^{m}C_{ds}{}^{m}C_{ks}A_{ds}G_{k}$ | 31 | 2853 |
| 1198970 | N/A | N/A | 119671 | 119686 | TAAGTAAGGTTTCCCA | $T_{ks}A_{ks}A_{ds}G_{ds}T_{ds}A_{ds}A_{ds}G_{ds}G_{ds}T_{ds}T_{ds}T_{ks}{}^{m}C_{ds}{}^{m}C_{ks}{}^{m}C_{ds}A_{k}$ | 29 | 2854 |
| 1198971 | N/A | N/A | 119672 | 119687 | CTAAGTAAGGTTTCCC | ${}^{m}C_{ks}T_{ks}A_{ds}A_{ds}G_{ds}T_{ds}A_{ds}A_{ds}G_{ds}G_{ds}T_{ds}T_{ks}T_{ds}{}^{m}C_{ks}{}^{m}C_{ds}{}^{m}C_{k}$ | 31 | 1101 |
| 1198972 | N/A | N/A | 119673 | 119688 | ACTAAGTAAGGTTTCC | $A_{ks}{}^{m}C_{ks}T_{ds}A_{ds}A_{ds}G_{ds}T_{ds}A_{ds}A_{ds}G_{ds}G_{ds}T_{ks}T_{ks}T_{ks}{}^{m}C_{ds}{}^{m}C_{k}$ | 46 | 2855 |
| 1198973 | N/A | N/A | 119674 | 119689 | GACTAAGTAAGGTTTC | $G_{ks}A_{ks}{}^{m}C_{ds}T_{ds}A_{ds}A_{ds}G_{ds}T_{ds}A_{ds}A_{ds}G_{ds}G_{ks}T_{ds}T_{ks}T_{ds}{}^{m}C_{k}$ | 53 | 2856 |
| 1198974 | N/A | N/A | 119675 | 119690 | AGACTAAGTAAGGTTT | $A_{ks}G_{ks}A_{ds}{}^{m}C_{ds}T_{ds}A_{ds}A_{ds}G_{ds}T_{ds}A_{ds}A_{ds}G_{ks}G_{ds}T_{ks}T_{ds}T_{k}$ | 73 | 2857 |
| 1198975 | N/A | N/A | 119677 | 119692 | TTAGACTAAGTAAGGT | $T_{ks}T_{ks}A_{ds}G_{ds}A_{ds}{}^{m}C_{ds}T_{ds}A_{ds}A_{ds}G_{ds}T_{ds}A_{ks}A_{ds}G_{ks}G_{ds}T_{k}$ | 52 | 2858 |

Table 46

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 (% UT) | YAP1 SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^{m}C_{ds}T_{ds}T_{ds}{}^{m}C_{ds}A_{ds}T_{ds}A_{ds}G_{ds}{}^{m}C_{ds}T_{ks}T_{ks}A_{k}$ | 25 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^{m}C_{ks}A_{k}$ | 16 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^{m}C_{ds}T_{ds}{}^{m}C_{ds}A_{ds}T_{ds}G_{ks}{}^{m}C_{ks}{}^{m}C_{k}$ | 14 | 2800 |
| 1095407 | 4443 | 4458 | 125468 | 125483 | ACTGAGGTATAACTGG | $A_{ks}{}^{m}C_{ks}T_{ds}G_{ds}A_{ds}G_{ds}G_{ds}T_{ds}A_{ds}T_{ds}A_{ds}A_{ks}{}^{m}C_{es}T_{es}G_{es}G_{k}$ | 54 | 392 |
| 1095425 | 4441 | 4456 | 125466 | 125481 | TGAGGTATAACTGGGC | $T_{ks}G_{ks}A_{ds}G_{ds}G_{ds}T_{ds}A_{ds}T_{ds}A_{ds}A_{ds}{}^{m}C_{ds}T_{ks}G_{es}G_{ks}G_{es}{}^{m}C_{k}$ | 57 | 1580 |
| 1095426 | 4442 | 4457 | 125467 | 125482 | CTGAGGTATAACTGGG | ${}^{m}C_{ks}T_{ks}G_{ds}A_{ds}G_{ds}G_{ds}T_{ds}A_{ds}T_{ds}A_{ds}A_{ds}{}^{m}C_{ks}T_{es}G_{es}G_{es}G_{k}$ | 54 | 2801 |

Table 46-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 (% UT) | YAP1 SEQ ID NO |
|---|---|---|---|---|---|---|---|---|
| 1095427 | 4444 | 4459 | 125469 | 125484 | CACTGAGGTATAACTG | $^mC_{ks}A_{ks}{}^mC_{ds}T_{ds}G_{ds}A_{ds}G_{ds}G_{ds}T_{ds}A_{ds}T_{ds}A_{ks}A_{es}{}^mC_{ks}T_{es}G_k$ | 45 | 2802 |
| 1198804 | 2524 | 2539 | 123549 | 123564 | TGTCTCATGCCTTATA | $T_{ks}G_{ks}T_{ds}{}^mC_{ds}T_{ds}{}^mC_{ds}A_{ds}T_{ds}G_{ds}{}^mC_{ds}{}^mC_{ds}T_{ks}T_{es}A_{ks}T_{es}A_k$ | 22 | 2803 |
| 1198805 | 2526 | 2541 | 123551 | 123566 | ATTGTCTCATGCCTTA | $A_{ks}T_{ks}T_{ds}G_{ds}T_{ds}{}^mC_{ds}T_{ds}{}^mC_{ds}A_{ds}T_{ds}G_{ds}{}^mC_{ds}{}^mC_{es}T_{ks}T_{es}A_k$ | 23 | 2804 |
| 1198806 | 2527 | 2542 | 123552 | 123567 | AATTGTCTCATGCCTT | $A_{ks}A_{ks}T_{ds}T_{ds}G_{ds}T_{ds}{}^mC_{ds}T_{ds}{}^mC_{ds}A_{ds}T_{ds}G_{ks}{}^mC_{es}{}^mC_{ks}T_{es}T_k$ | 33 | 2805 |
| 1198807 | 2528 | 2543 | 123553 | 123568 | AAATTGTCTCATGCCT | $A_{ks}A_{ks}A_{ds}T_{ds}T_{ds}G_{ds}T_{ds}{}^mC_{ds}T_{ds}{}^mC_{ds}A_{ds}T_{ks}G_{es}{}^mC_{ks}{}^mC_{es}T_k$ | 44 | 433 |
| 1198808 | 2529 | 2544 | 123554 | 123569 | GAAATTGTCTCATGCC | $G_{ks}A_{ks}A_{ds}A_{ds}T_{ds}T_{ds}G_{ds}T_{ds}{}^mC_{ds}T_{ds}{}^mC_{ds}A_{ks}T_{es}G_{ks}{}^mC_{es}{}^mC_k$ | 40 | 2800 |
| 1198809 | 2530 | 2545 | 123555 | 123570 | GGAAATTGTCTCATGC | $G_{ks}G_{ks}A_{ds}A_{ds}A_{ds}T_{ds}T_{ds}G_{ds}T_{ds}{}^mC_{ds}T_{ds}{}^mC_{ks}A_{es}T_{ks}G_{es}{}^mC_k$ | 27 | 2806 |
| 1198810 | 2531 | 2546 | 123556 | 123571 | TGGAAATTGTCTCATG | $T_{ks}G_{ks}G_{ds}A_{ds}A_{ds}A_{ds}T_{ds}T_{ds}G_{ds}T_{ds}{}^mC_{ds}T_{ks}{}^mC_{es}A_{ks}T_{es}G_k$ | 50 | 2807 |
| 1198811 | 2532 | 2547 | 123557 | 123572 | ATGGAAATTGTCTCAT | $A_{ks}T_{ks}G_{ds}G_{ds}A_{ds}A_{ds}A_{ds}T_{ds}T_{ds}G_{ds}T_{ds}{}^mC_{ks}T_{es}{}^mC_{ks}A_{es}T_k$ | 38 | 2808 |
| 1198812 | 2534 | 2549 | 123559 | 123574 | ATATGGAAATTGTCTC | $A_{ks}T_{ks}A_{ds}T_{ds}G_{ds}G_{ds}A_{ds}A_{ds}A_{ds}T_{ds}T_{ds}G_{ks}T_{es}{}^mC_{ks}T_{es}{}^mC_k$ | 26 | 656 |
| 1198813 | 2560 | 2575 | 123585 | 123600 | AGTATGTGGCAATAAT | $A_{ks}G_{ks}T_{ds}A_{ds}T_{ds}G_{ds}T_{ds}G_{ds}G_{ds}{}^mC_{ds}A_{ds}A_{ks}T_{es}A_{ks}A_{es}T_k$ | 55 | 2809 |
| 1198814 | 2562 | 2577 | 123587 | 123602 | AGAGTATGTGGCAATA | $A_{ks}G_{ks}A_{ds}G_{ds}T_{ds}A_{ds}T_{ds}G_{ds}T_{ds}G_{ds}G_{ds}{}^mC_{ks}A_{es}A_{ks}T_{es}A_K$ | 13 | 2810 |
| 1198815 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}G_{ks}{}^mC_{es}A_{ks}A_{es}T_k$ | 24 | 2811 |
| 1198816 | 2564 | 2579 | 123589 | 123604 | TTAGAGTATGTGGCAA | $T_{ks}T_{ks}A_{ds}G_{ds}A_{ds}G_{ds}T_{ds}A_{ds}T_{ds}G_{ds}T_{ds}G_{ks}G_{es}{}^mC_{ks}A_{es}A_k$ | 27 | 963 |
| 1198817 | 2565 | 2580 | 123590 | 123605 | ATTAGAGTATGTGGCA | $A_{ks}T_{ks}T_{ds}A_{ds}G_{ds}A_{ds}G_{ds}T_{ds}A_{ds}T_{ds}G_{ds}T_{ks}G_{es}G_{ks}{}^mC_{es}A_k$ | 43 | 810 |
| 1198818 | 2566 | 2581 | 123591 | 123606 | TATTAGAGTATGTGGC | $T_{ks}A_{ks}T_{ds}T_{ds}A_{ds}G_{ds}A_{ds}G_{ds}T_{ds}A_{ds}T_{ds}G_{ks}T_{es}G_{ks}G_{es}{}^mC_k$ | 15 | 2812 |
| 1198819 | 2567 | 2582 | 123592 | 123607 | ATATTAGAGTATGTGG | $A_{ks}T_{ks}A_{ds}T_{ds}T_{ds}A_{ds}G_{ds}A_{ds}G_{ds}T_{ds}A_{ds}T_{ks}G_{es}T_{ks}G_{es}G_k$ | 44 | 2813 |
| 1198820 | 2568 | 2583 | 123593 | 123608 | TATATTAGAGTATGTG | $T_{ks}A_{ks}T_{ds}A_{ds}T_{ds}T_{ds}A_{ds}G_{ds}A_{ds}G_{ds}T_{ds}A_{ks}T_{es}G_{ks}T_{es}G_k$ | 62 | 2814 |
| 1198821 | 2570 | 2585 | 123595 | 123610 | TCTATATTAGAGTATG | $T_{ks}{}^mC_{ks}T_{ds}A_{ds}T_{ds}A_{ds}T_{ds}T_{ds}A_{ds}G_{ds}A_{ds}G_{ks}T_{es}A_{ks}T_{es}G_k$ | 62 | 887 |
| 1198822 | 4436 | 4451 | 125461 | 125476 | TATAACTGGGCAAATT | $T_{ks}A_{ks}T_{ds}A_{ds}A_{ds}{}^mC_{ds}T_{ds}G_{ds}G_{ds}G_{ds}{}^mC_{ds}A_{ks}A_{es}A_{ks}T_{es}T_k$ | 97 | 2815 |
| 1198823 | 4438 | 4453 | 125463 | 125478 | GGTATAACTGGGCAAA | $G_{ks}G_{ks}T_{ds}A_{ds}T_{ds}A_{ds}A_{ds}{}^mC_{ds}T_{ds}G_{ds}G_{ks}{}^mC_{es}A_{ks}A_{es}A_k$ | 65 | 1427 |
| 1198824 | 4439 | 4454 | 125464 | 125479 | AGGTATAACTGGGCAA | $A_{ks}G_{ks}G_{ds}T_{ds}A_{ds}T_{ds}A_{ds}A_{ds}{}^mC_{ds}T_{ds}G_{ds}G_{ks}G_{es}{}^mC_{ks}A_{es}A_k$ | 72 | 905 |
| 1198825 | 4440 | 4455 | 125465 | 125480 | GAGGTATAACTGGGCA | $G_{ks}A_{ks}G_{ds}G_{ds}T_{ds}A_{ds}T_{ds}A_{ds}A_{ds}{}^mC_{ds}T_{ds}G_{es}G_{ks}{}^mC_{es}A_k$ | 64 | 1503 |
| 1198826 | 4446 | 4461 | 125471 | 125486 | AACACTGAGGTATAAC | $A_{ks}A_{ks}{}^mC_{ds}A_{ds}{}^mC_{ds}T_{ds}G_{ds}A_{ds}G_{ds}G_{ds}T_{ds}A_{ks}T_{es}A_{ks}A_{es}{}^mC_k$ | 64 | 2816 |
| 1198827 | 4595 | 4610 | 125620 | 125635 | TTACATTAGGAACAAG | $T_{ks}T_{ks}A_{ds}{}^mC_{ds}A_{ds}T_{ds}T_{ds}A_{ds}G_{ds}G_{ds}A_{ds}A_{ks}{}^mC_{es}A_{ks}A_{es}G_k$ | 60 | 2817 |
| 1198828 | 4597 | 4612 | 125622 | 125637 | TTTTACATTAGGAACA | $T_{ks}T_{ks}T_{ds}T_{ds}A_{ds}{}^mC_{ds}A_{ds}T_{ds}T_{ds}A_{ds}G_{ds}G_{ks}A_{es}A_{ks}{}^mC_{es}A_k$ | 59 | 2818 |
| 1198829 | 4598 | 4613 | 125623 | 125638 | CTTTTACATTAGGAAC | $^mC_{ks}T_{ks}T_{ds}T_{ds}A_{ds}{}^mC_{ds}A_{ds}T_{ds}T_{ds}A_{ds}G_{ks}G_{es}A_{ks}A_{es}{}^mC_k$ | 36 | 1124 |
| 1198830 | 4599 | 4614 | 125624 | 125639 | ACTTTTACATTAGGAA | $^mA_{ks}{}^mC_{ks}T_{ds}T_{ds}T_{ds}T_{ds}A_{ds}{}^mC_{ds}A_{ds}T_{ds}T_{ds}A_{ks}G_{es}G_{ks}A_{es}A_k$ | 37 | 2819 |
| 1198831 | 4600 | 4615 | 125625 | 125640 | CACTTTTACATTAGGA | $^mC_{ks}A_{ks}{}^mC_{ds}T_{ds}T_{ds}T_{ds}T_{ds}A_{ds}{}^mC_{ds}A_{ds}T_{ds}T_{ks}A_{es}G_{ks}G_{es}A_k$ | 12 | 1200 |
| 1198832 | 4601 | 4616 | 125626 | 125641 | GCACTTTTACATTAGG | $G_{ks}{}^mC_{ks}A_{ds}{}^mC_{ds}T_{ds}T_{ds}T_{ds}T_{ds}A_{ds}{}^mC_{ds}A_{ds}T_{ks}T_{es}A_{ks}G_{es}G_k$ | 20 | 1276 |
| 1198833 | 4602 | 4617 | 125627 | 125642 | AGCACTTTTACATTAG | $A_{ks}G_{ks}{}^mC_{ds}A_{ds}{}^mC_{ds}T_{ds}T_{ds}T_{ds}T_{ds}A_{ds}{}^mC_{ds}A_{ks}T_{es}T_{ks}A_{es}G_k$ | 54 | 2820 |
| 1198834 | 4603 | 4618 | 125628 | 125643 | AAGCACTTTTACATTA | $A_{ks}A_{ks}G_{ds}{}^mC_{ds}A_{ds}{}^mC_{ds}T_{ds}T_{ds}T_{ds}T_{ds}A_{ds}{}^mC_{ks}A_{es}T_{ks}T_{es}A_k$ | 54 | 2821 |
| 1198835 | 4605 | 4620 | 125630 | 125645 | TTAAGCACTTTTACAT | $T_{ks}T_{ks}A_{ds}A_{ds}G_{ds}{}^mC_{ds}A_{ds}{}^mC_{ds}T_{ds}T_{ds}T_{ks}A_{es}{}^mC_{ks}A_{es}T_k$ | 85 | 2822 |
| 1198836 | 4795 | 4810 | 125820 | 125835 | GGAAGATCTGAAACTC | $G_{ks}G_{ks}A_{ds}A_{ds}G_{ds}A_{ds}T_{ds}{}^mC_{ds}T_{ds}G_{ds}A_{ds}A_{ks}A_{es}{}^mC_{ks}T_{es}{}^mC_k$ | 43 | 2823 |
| 1198837 | 4797 | 4812 | 125822 | 125837 | TTGGAAGATCTGAAAC | $T_{ks}T_{ks}G_{ds}G_{ds}A_{ds}A_{ds}G_{ds}A_{ds}T_{ds}{}^mC_{ds}T_{ds}G_{ks}A_{es}A_{ks}A_{es}{}^mC_k$ | 66 | 2824 |
| 1198838 | 4798 | 4813 | 125823 | 125838 | TTTGGAAGATCTGAAA | $T_{ks}T_{ks}T_{ds}G_{ds}G_{ds}A_{ds}A_{ds}G_{ds}A_{ds}T_{ds}{}^mC_{ds}T_{ks}G_{es}A_{ks}A_{es}A_k$ | 66 | 2825 |

Table 46-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 YAP1 (% UT) | SEQ ID NO |
|---|---|---|---|---|---|---|---|---|
| 1198839 | 4799 | 4814 | 125824 | 125839 | CTTTGGAAGATCTGAA | mC$_{ks}$T$_{ks}$T$_{ds}$T$_{ds}$G$_{ds}$G$_{ds}$A$_{ds}$A$_{ds}$G$_{ds}$A$_{ds}$T$_{ds}$mC$_{ks}$T$_{es}$G$_{ks}$A$_{es}$A$_k$ | 36 | 2826 |
| 1198840 | 4800 | 4815 | 125825 | 125840 | GCTTTGGAAGATCTGA | G$_{ks}$mC$_{ds}$T$_{ds}$T$_{ds}$T$_{ds}$G$_{ds}$G$_{ds}$A$_{ds}$A$_{ds}$G$_{ds}$A$_{ds}$T$_{ks}$mC$_{es}$T$_{ks}$G$_{es}$A$_k$ | 26 | 2044 |
| 1198841 | 4801 | 4816 | 125826 | 125841 | TGCTTTGGAAGATCTG | T$_{ks}$G$_{ks}$mC$_{ds}$T$_{ds}$T$_{ds}$T$_{ds}$G$_{ds}$G$_{ds}$A$_{ds}$A$_{ds}$G$_{ds}$A$_{ks}$T$_{es}$mC$_{ks}$T$_{es}$G$_k$ | 116 | 2121 |
| 1198842 | 4802 | 4817 | 125827 | 125842 | GTGCTTTGGAAGATCT | G$_{ks}$T$_{ks}$G$_{ds}$mC$_{ds}$T$_{ds}$T$_{ds}$T$_{ds}$G$_{ds}$G$_{ds}$A$_{ds}$A$_{ds}$G$_{ks}$A$_{es}$T$_{ks}$mC$_{es}$T$_k$ | 37 | 2827 |
| 1198843 | 4803 | 4818 | 125828 | 125843 | AGTGCTTTGGAAGATC | A$_{ks}$G$_{ks}$T$_{ds}$G$_{ds}$mC$_{ds}$T$_{ds}$T$_{ds}$T$_{ds}$G$_{ds}$G$_{ds}$A$_{ds}$A$_{ks}$G$_{es}$A$_{ks}$T$_{es}$mC$_k$ | 45 | 2828 |
| 1198844 | 4805 | 4820 | 125830 | 125845 | ATAGTGCTTTGGAAGA | A$_{ks}$T$_{ks}$A$_{ds}$G$_{ds}$T$_{ds}$G$_{ds}$mC$_{ds}$T$_{ds}$T$_{ds}$T$_{ds}$G$_{ds}$G$_{ks}$A$_{es}$A$_{ks}$G$_{es}$A$_k$ | 56 | 2829 |
| 1198845 | N/A | N/A | 94729 | 94744 | AGGATGCATGGTTTTT | A$_{ks}$G$_{ks}$G$_{ds}$A$_{ds}$T$_{ds}$G$_{ds}$mC$_{ds}$A$_{ds}$T$_{ds}$G$_{ds}$G$_{ds}$T$_{ks}$T$_{es}$T$_{ks}$T$_{es}$T$_k$ | 43 | 2830 |
| 1198846 | N/A | N/A | 94731 | 94746 | TTAGGATGCATGGTTT | T$_{ks}$T$_{ks}$A$_{ds}$G$_{ds}$G$_{ds}$A$_{ds}$T$_{ds}$G$_{ds}$mC$_{ds}$A$_{ds}$T$_{ds}$G$_{ks}$G$_{es}$T$_{ks}$T$_{es}$T$_k$ | 34 | 2831 |
| 1198847 | N/A | N/A | 94732 | 94747 | TTTAGGATGCATGGTT | T$_{ks}$T$_{ks}$T$_{ds}$A$_{ds}$G$_{ds}$G$_{ds}$A$_{ds}$T$_{ds}$G$_{ds}$mC$_{ds}$A$_{ds}$T$_{ks}$G$_{es}$G$_{ks}$T$_{es}$T$_k$ | 51 | 2832 |
| 1198848 | N/A | N/A | 94733 | 94748 | ATTTAGGATGCATGGT | A$_{ks}$T$_{ds}$T$_{ds}$T$_{ds}$A$_{ds}$G$_{ds}$G$_{ds}$A$_{ds}$T$_{ds}$G$_{ds}$mC$_{ds}$A$_{ks}$T$_{es}$G$_{ks}$G$_{es}$T$_k$ | 47 | 2833 |
| 1198849 | N/A | N/A | 94734 | 94749 | GATTTAGGATGCATGG | G$_{ks}$A$_{ks}$T$_{ds}$T$_{ds}$T$_{ds}$A$_{ds}$G$_{ds}$G$_{ds}$A$_{ds}$T$_{ds}$G$_{ds}$mC$_{ks}$A$_{es}$T$_{ks}$G$_{es}$G$_k$ | 42 | 2834 |
| 1198850 | N/A | N/A | 94735 | 94750 | AGATTTAGGATGCATG | A$_{ks}$G$_{ks}$A$_{ds}$T$_{ds}$T$_{ds}$T$_{ds}$A$_{ds}$G$_{ds}$G$_{ds}$A$_{ds}$T$_{ds}$G$_{ks}$mC$_{es}$A$_{ks}$T$_{es}$G$_k$ | 33 | 2835 |
| 1198851 | N/A | N/A | 94736 | 94751 | CAGATTTAGGATGCAT | mC$_{ks}$A$_{ds}$G$_{ds}$A$_{ds}$T$_{ds}$T$_{ds}$T$_{ds}$A$_{ds}$G$_{ds}$G$_{ds}$A$_{ds}$T$_{ks}$G$_{es}$mC$_{ks}$A$_{es}$T$_k$ | 82 | 2836 |
| 1198852 | N/A | N/A | 94737 | 94752 | TCAGATTTAGGATGCA | T$_{ks}$mC$_{ks}$A$_{ds}$G$_{ds}$A$_{ds}$T$_{ds}$T$_{ds}$T$_{ds}$A$_{ds}$G$_{ds}$G$_{ds}$A$_{ks}$T$_{es}$G$_{ks}$mC$_{es}$A$_k$ | 41 | 2837 |
| 1198853 | N/A | N/A | 94739 | 94754 | ATTCAGATTTAGGATG | A$_{ks}$T$_{ks}$T$_{ds}$mC$_{ds}$A$_{ds}$G$_{ds}$A$_{ds}$T$_{ds}$T$_{ds}$T$_{ds}$A$_{ds}$G$_{ks}$G$_{es}$A$_{ks}$T$_{es}$G$_k$ | 105 | 2838 |
| 1198854 | N/A | N/A | 115903 | 115918 | ATATGGTTTTGTGTGT | A$_{ks}$T$_{ks}$A$_{ds}$T$_{ds}$G$_{ds}$G$_{ds}$T$_{ds}$T$_{ds}$T$_{ds}$T$_{ds}$G$_{ds}$T$_{ks}$G$_{es}$T$_{ks}$G$_{es}$T$_k$ | 56 | 2839 |
| 1198855 | N/A | N/A | 115905 | 115920 | TTATATGGTTTTGTGT | T$_{ks}$T$_{ks}$A$_{ds}$T$_{ds}$A$_{ds}$T$_{ds}$G$_{ds}$G$_{ds}$T$_{ds}$T$_{ds}$T$_{ds}$T$_{ks}$G$_{es}$T$_{ks}$G$_{es}$T$_k$ | 30 | 2840 |
| 1198856 | N/A | N/A | 115906 | 115921 | CTTATATGGTTTTGTG | mC$_{ks}$T$_{ks}$T$_{ds}$A$_{ds}$T$_{ds}$A$_{ds}$T$_{ds}$G$_{ds}$G$_{ds}$T$_{ds}$T$_{ds}$T$_{ks}$T$_{es}$G$_{ks}$T$_{es}$G$_k$ | 20 | 2788 |
| 1198857 | N/A | N/A | 115907 | 115922 | TCTTATATGGTTTTGT | T$_{ks}$mC$_{ks}$T$_{ds}$T$_{ds}$A$_{ds}$T$_{ds}$A$_{ds}$T$_{ds}$G$_{ds}$G$_{ds}$T$_{ds}$T$_{ks}$T$_{es}$T$_{ks}$G$_{es}$T$_k$ | 19 | 2841 |
| 1198863 | N/A | N/A | 117325 | 117340 | ATTGCAATCTGTCTGA | A$_{ks}$T$_{ks}$T$_{ds}$G$_{ds}$mC$_{ds}$A$_{ds}$A$_{ds}$T$_{ds}$mC$_{ds}$T$_{ds}$G$_{ds}$T$_{ks}$mC$_{es}$T$_{ks}$G$_{es}$A$_k$ | 65 | 2843 |
| 1198864 | N/A | N/A | 117327 | 117342 | ATATTGCAATCTGTCT | A$_{ks}$T$_{ks}$A$_{ds}$T$_{ds}$T$_{ds}$G$_{ds}$mC$_{ds}$A$_{ds}$A$_{ds}$T$_{ds}$mC$_{ds}$T$_{ks}$G$_{es}$T$_{ks}$mC$_{es}$T$_k$ | 56 | 2844 |
| 1198865 | N/A | N/A | 117328 | 117343 | AATATTGCAATCTGTC | A$_{ks}$A$_{ks}$T$_{ds}$A$_{ds}$T$_{ds}$T$_{ds}$G$_{ds}$mC$_{ds}$A$_{ds}$A$_{ds}$T$_{ds}$mC$_{ks}$T$_{es}$G$_{ks}$T$_{es}$mC$_k$ | 38 | 2845 |
| 1198866 | N/A | N/A | 117329 | 117344 | TAATATTGCAATCTGT | T$_{ks}$A$_{ks}$A$_{ds}$T$_{ds}$A$_{ds}$T$_{ds}$T$_{ds}$G$_{ds}$mC$_{ds}$A$_{ds}$A$_{ds}$T$_{ks}$mC$_{es}$T$_{ks}$G$_{es}$T$_k$ | 60 | 2846 |
| 1198867 | N/A | N/A | 117330 | 117345 | GTAATATTGCAATCTG | G$_{ks}$T$_{ks}$A$_{ds}$A$_{ds}$T$_{ds}$A$_{ds}$T$_{ds}$T$_{ds}$G$_{ds}$mC$_{ds}$A$_{ds}$A$_{ks}$T$_{es}$mC$_{ks}$T$_{es}$G$_k$ | 25 | 1404 |
| 1198868 | N/A | N/A | 117331 | 117346 | TGTAATATTGCAATCT | T$_{ks}$G$_{ks}$T$_{ds}$A$_{ds}$A$_{ds}$T$_{ds}$A$_{ds}$T$_{ds}$T$_{ds}$G$_{ds}$mC$_{ds}$A$_{ks}$A$_{es}$T$_{ks}$mC$_{es}$T$_k$ | 49 | 2847 |
| 1198869 | N/A | N/A | 117332 | 117347 | ATGTAATATTGCAATC | A$_{ks}$T$_{ks}$G$_{ds}$T$_{ds}$A$_{ds}$A$_{ds}$T$_{ds}$A$_{ds}$T$_{ds}$T$_{ds}$G$_{ds}$mC$_{ks}$A$_{es}$A$_{ks}$T$_{es}$mC$_k$ | 49 | 2848 |
| 1198870 | N/A | N/A | 117333 | 117348 | TATGTAATATTGCAAT | T$_{ks}$A$_{ks}$T$_{ds}$G$_{ds}$T$_{ds}$A$_{ds}$A$_{ds}$T$_{ds}$A$_{ds}$T$_{ds}$T$_{ds}$G$_{ks}$mC$_{es}$A$_{ks}$A$_{es}$T$_k$ | 86 | 2849 |
| 1198871 | N/A | N/A | 117335 | 117350 | TTTATGTAATATTGCA | T$_{ks}$T$_{ks}$T$_{ds}$A$_{ds}$T$_{ds}$G$_{ds}$T$_{ds}$A$_{ds}$A$_{ds}$T$_{ds}$A$_{ds}$T$_{ks}$T$_{es}$G$_{ks}$mC$_{es}$A$_k$ | 77 | 2850 |
| 1198881 | N/A | N/A | 119667 | 119682 | TAAGGTTTCCCAGATT | T$_{ks}$A$_{ks}$A$_{ds}$G$_{ds}$G$_{ds}$T$_{ds}$T$_{ds}$T$_{ds}$mC$_{ds}$mC$_{ds}$mC$_{ds}$A$_{ks}$G$_{es}$A$_{ks}$T$_{es}$T$_k$ | 36 | 2851 |
| 1198882 | N/A | N/A | 119669 | 119684 | AGTAAGGTTTCCCAGA | A$_{ks}$G$_{ks}$T$_{ds}$A$_{ds}$A$_{ds}$G$_{ds}$G$_{ds}$T$_{ds}$T$_{ds}$T$_{ds}$mC$_{ds}$mC$_{ks}$mC$_{es}$A$_{ks}$G$_{es}$A$_k$ | 56 | 2852 |
| 1198883 | N/A | N/A | 119670 | 119685 | AAGTAAGGTTTCCCAG | A$_{ks}$A$_{ks}$G$_{ds}$T$_{ds}$A$_{ds}$A$_{ds}$G$_{ds}$G$_{ds}$T$_{ds}$T$_{ds}$T$_{ds}$mC$_{ks}$mC$_{es}$mC$_{ks}$A$_{es}$G$_k$ | 47 | 2853 |
| 1198884 | N/A | N/A | 119671 | 119686 | TAAGTAAGGTTTCCCA | T$_{ks}$A$_{ks}$A$_{ds}$G$_{ds}$T$_{ds}$A$_{ds}$A$_{ds}$G$_{ds}$G$_{ds}$T$_{ds}$T$_{ds}$T$_{ks}$mC$_{es}$mC$_{ks}$mC$_{es}$A$_k$ | 28 | 2854 |
| 1198885 | N/A | N/A | 119672 | 119687 | CTAAGTAAGGTTTCCC | mC$_{ks}$T$_{ks}$A$_{ds}$A$_{ds}$G$_{ds}$T$_{ds}$A$_{ds}$A$_{ds}$G$_{ds}$G$_{ds}$T$_{ds}$T$_{ks}$T$_{es}$mC$_{ks}$mC$_{es}$mC$_k$ | 41 | 1101 |
| 1198886 | N/A | N/A | 119673 | 119688 | ACTAAGTAAGGTTTCC | A$_{ks}$mC$_{ks}$T$_{ds}$A$_{ds}$A$_{ds}$G$_{ds}$T$_{ds}$A$_{ds}$A$_{ds}$G$_{ds}$G$_{ds}$T$_{ks}$T$_{es}$T$_{ks}$mC$_{es}$mC$_k$ | 45 | 2855 |
| 1198887 | N/A | N/A | 119674 | 119689 | GACTAAGTAAGGTTTC | G$_{ks}$A$_{ks}$mC$_{ds}$T$_{ds}$A$_{ds}$A$_{ds}$G$_{ds}$T$_{ds}$A$_{ds}$A$_{ds}$G$_{ds}$G$_{ks}$T$_{es}$T$_{ks}$T$_{es}$mC$_k$ | 71 | 2856 |
| 1198888 | N/A | N/A | 119675 | 119690 | AGACTAAGTAAGGTTT | A$_{ks}$G$_{ks}$A$_{ds}$mC$_{ds}$T$_{ds}$A$_{ds}$A$_{ds}$G$_{ds}$T$_{ds}$A$_{ds}$A$_{ds}$G$_{ks}$G$_{es}$T$_{ks}$T$_{es}$T$_k$ | 51 | 2857 |

Table 46-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1198889 | N/A | N/A | 119677 | 119692 | TTAGACTAAGTAAGGT | $T_{ks}T_{ks}A_{ds}G_{ds}A_{ds}{}^{m}C_{ds}T_{ds}A_{ds}A_{ds}G_{ds}T_{ds}A_{ks}A_{es}G_{ks}G_{es}T_{k}$ | 27 | 2858 |
| 1198966 | N/A | N/A | 117765 | 117780 | AACTTTAAAGTGTATG | $A_{ks}A_{ks}{}^{m}C_{ds}T_{ds}T_{ds}T_{ds}A_{ds}A_{ds}A_{ds}G_{ds}T_{ds}G_{ks}T_{ds}A_{ks}T_{ds}G_{k}$ | 78 | 2870 |

Table 47

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^{m}C_{ds}T_{ds}T_{ds}{}^{m}C_{ds}A_{ds}T_{ds}A_{ds}G_{ds}{}^{m}C_{ds}T_{ks}T_{ks}A_{k}$ | 39 | 52 |
| 716444 | 2528 | 2543 | 123553 | 123568 | AAATTGTCTCATGCCT | $A_{ks}A_{ks}A_{ks}T_{ds}T_{ds}G_{ds}T_{ds}{}^{m}C_{ds}T_{ds}{}^{m}C_{ds}A_{ds}T_{ds}G_{ds}{}^{m}C_{ks}{}^{m}C_{ks}T_{k}$ | 46 | 443 |
| 958497 | 2534 | 2549 | 123559 | 123574 | ATATGGAAATTGTCTC | $A_{ks}T_{ks}A_{ks}T_{ds}G_{ds}G_{ds}A_{ds}A_{ds}A_{ds}T_{ds}T_{ds}G_{ds}T_{ds}{}^{m}C_{ks}T_{ks}{}^{m}C_{k}$ | 20 | 656 |
| 958499 | 2565 | 2580 | 123590 | 123605 | ATTAGAGTATGTGGCA | $A_{ks}T_{ks}T_{ks}A_{ds}G_{ds}A_{ds}G_{s}T_{ds}A_{ds}T_{ds}G_{ds}T_{ds}G_{ds}G_{ks}{}^{m}C_{ks}A_{k}$ | 17 | 810 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^{m}C_{ks}A_{k}$ | 10 | 810 |
| 958500 | 2570 | 2585 | 123595 | 123610 | TCTATATTAGAGTATG | $T_{ks}{}^{m}C_{ks}T_{ks}A_{ds}T_{ds}A_{ds}T_{ds}T_{ds}A_{ds}G_{ds}A_{ds}G_{ds}T_{ds}A_{ks}T_{ks}G_{k}$ | 53 | 887 |
| 1009324 | 2560 | 2575 | 36419 36434 63341 63356 123585 123600 | | AGTATGTGGCAATAAT | $A_{ks}G_{ks}T_{ks}A_{ds}T_{ds}G_{ds}T_{ds}G_{ds}G_{ds}{}^{m}C_{ds}A_{ds}A_{ds}T_{ds}A_{ks}A_{ks}T_{k}$ | 27 | 2809 |
| 1009325 | 2562 | 2577 | 63343 63358 71690 71705 123587 123602 | | AGAGTATGTGGCAATA | $A_{ks}G_{ks}A_{ks}G_{ds}T_{ds}A_{ds}T_{ds}G_{ds}T_{ds}G_{ds}G_{ds}{}^{m}C_{ds}A_{ds}A_{ks}T_{ks}A_{k}$ | 16 | 2810 |
| 1009326 | 2566 | 2581 | 123591 | 123606 | TATTAGAGTATGTGGC | $T_{ks}A_{ks}T_{ks}T_{ds}A_{ds}G_{ds}A_{ds}G_{ds}T_{ds}A_{ds}T_{ds}G_{ds}T_{ds}G_{ks}G_{ks}{}^{m}C_{k}$ | 10 | 2812 |
| 1009327 | 2567 | 2582 | 123592 | 123607 | ATATTAGAGTATGTGG | $A_{ks}T_{ks}A_{ks}T_{ds}T_{ds}A_{ds}G_{ds}A_{ds}G_{ds}T_{ds}A_{ds}T_{ds}G_{ds}T_{ks}G_{ks}G_{k}$ | 27 | 2813 |
| 1009328 | 2568 | 2583 | 123593 | 123608 | TATATTAGAGTATGTG | $T_{ks}A_{ks}T_{ks}A_{ds}T_{ds}T_{ds}A_{ds}G_{ds}A_{ds}G_{ds}T_{ds}A_{ds}T_{ds}G_{ks}T_{ks}G_{k}$ | 67 | 2814 |
| 1009394 | 2223 4436 | 2238 4451 | 123248 125461 | 123263 125476 | TATAACTGGGCAAATT | $T_{ks}A_{ks}T_{ks}A_{ds}A_{ds}{}^{m}C_{ds}T_{ds}G_{ds}G_{ds}G_{ds}{}^{m}C_{ds}A_{ds}A_{ds}A_{ks}T_{ks}T_{k}$ | 73 | 2815 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^{m}C_{ds}T_{ds}{}^{m}C_{ds}A_{ds}T_{ds}G_{ks}{}^{m}C_{ks}{}^{m}C_{k}$ | 5 | 2800 |
| 1074462 | 2530 | 2545 | 123555 | 123570 | GGAAATTGTCTCATGC | $G_{ks}G_{ks}A_{ks}A_{ds}A_{ds}T_{ds}T_{ds}G_{ds}T_{ds}{}^{m}C_{ds}T_{ds}{}^{m}C_{ds}A_{ds}T_{ks}G_{ks}{}^{m}C_{k}$ | 7 | 2806 |
| 1074463 | 2563 | 2578 | 123588 | 123603 | TAGAGTATGTGGCAAT | $T_{ks}A_{ks}G_{ks}A_{ds}G_{ds}T_{ds}A_{ds}T_{ds}G_{ds}T_{ds}G_{ds}G_{ds}{}^{m}C_{ds}A_{ks}A_{ks}T_{k}$ | 20 | 2811 |
| 1074464 | 2564 | 2579 | 123589 | 123604 | TTAGAGTATGTGGCAA | $T_{ks}T_{ks}A_{ks}G_{ds}A_{ds}G_{ds}T_{ds}A_{ds}T_{ds}G_{ds}T_{ds}G_{ds}G_{ds}{}^{m}C_{ks}A_{ks}A_{k}$ | 5 | 963 |
| 1074754 | 4598 | 4613 | 125623 | 125638 | CTTTTACATTAGGAAC | ${}^{m}C_{ks}T_{ks}T_{ks}T_{ds}T_{ds}A_{ds}{}^{m}C_{ds}A_{ds}T_{ds}T_{ds}A_{ds}G_{ds}G_{ds}A_{ks}A_{ks}{}^{m}C_{k}$ | 69 | 1124 |
| 1074755 | 4600 | 4615 | 125625 | 125640 | CACTTTTACATTAGGA | ${}^{m}C_{ks}A_{ks}{}^{m}C_{ds}T_{ds}T_{ds}T_{ds}T_{ds}A_{ds}{}^{m}C_{ds}A_{ds}T_{ds}T_{ds}A_{ds}G_{ks}G_{ks}A_{k}$ | 23 | 1200 |
| 1074756 | 4601 | 4616 | 125626 | 125641 | GCACTTTTACATTAGG | $G_{ks}{}^{m}C_{ks}A_{ks}{}^{m}C_{ds}T_{ds}T_{ds}T_{ds}T_{ds}A_{ds}{}^{m}C_{ds}A_{ds}T_{ds}T_{ds}A_{ks}G_{ks}G_{k}$ | 8 | 1276 |
| 1074798 | 4800 | 4815 | 125825 | 125840 | GCTTTGGAAGATCTGA | $G_{ks}{}^{m}C_{ks}T_{ks}T_{ds}T_{ds}G_{ds}G_{ds}A_{ds}A_{ds}G_{ds}A_{ds}T_{ds}{}^{m}C_{ds}T_{ks}G_{ks}A_{k}$ | 19 | 2044 |
| 1074799 | 4801 | 4816 | 125826 | 125841 | TGCTTTGGAAGATCTG | $T_{ks}G_{ks}{}^{m}C_{ks}T_{ds}T_{ds}T_{ds}G_{ds}G_{ds}A_{ds}A_{ds}G_{ds}A_{ds}T_{ds}{}^{m}C_{ks}T_{ks}G_{k}$ | 21 | 2121 |
| 1076186 | N/A | N/A | 94733 | 94748 | ATTTAGGATGCATGGT | $A_{ks}T_{ks}T_{ks}T_{ds}A_{ds}G_{ds}G_{ds}A_{ds}T_{ds}G_{ds}{}^{m}C_{ds}A_{ds}T_{ds}G_{ks}G_{ks}T_{k}$ | 31 | 2833 |
| 1076187 | N/A | N/A | 94734 | 94749 | GATTTAGGATGCATGG | $G_{ks}A_{ks}T_{ks}T_{ds}T_{ds}A_{ds}G_{ds}G_{ds}A_{ds}T_{ds}G_{ds}{}^{m}C_{ds}A_{ds}T_{ks}G_{ks}G_{k}$ | 17 | 2834 |
| 1076453 | N/A | N/A | 117330 | 117345 | GTAATATTGCAATCTG | $G_{ks}T_{ks}A_{ks}A_{ds}T_{ds}A_{ds}T_{ds}T_{ds}G_{ds}{}^{m}C_{ds}A_{ds}A_{ds}T_{ds}{}^{m}C_{ks}T_{ks}G_{k}$ | 7 | 1404 |
| 1076481 | N/A | N/A | 119672 | 119687 | CTAAGTAAGGTTTCCC | ${}^{m}C_{ks}T_{ks}A_{ks}A_{ds}G_{ds}T_{ds}A_{ds}A_{ds}G_{ds}G_{ds}T_{ds}T_{ds}T_{ds}{}^{m}C_{ks}{}^{m}C_{ks}{}^{m}C_{k}$ | 13 | 1101 |
| 1096369 | 4802 | 4817 | 125827 | 125842 | GTGCTTTGGAAGATCT | $G_{ks}T_{ks}G_{ks}{}^{m}C_{ds}T_{ds}T_{ds}T_{ds}G_{ds}G_{ds}A_{ds}A_{ds}G_{ds}A_{ds}T_{ks}{}^{m}C_{ks}T_{k}$ | 45 | 2827 |

Table 47-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1097037 | N/A | N/A | 94735 | 94750 | AGATTTAGGATGCATG | $A_{ks}G_{ks}A_{ks}T_{ds}T_{ds}T_{ds}A_{ds}G_{ds}G_{ds}A_{ds}T_{ds}G_{ds}{}^mC_{ds}A_{ks}T_{ks}G_k$ | 38 | 2835 |
| 1097238 | N/A | N/A | 117325 | 117340 | ATTGCAATCTGTCTGA | $A_{ks}T_{ks}T_{ks}G_{ds}{}^mC_{ds}A_{ds}A_{ds}T_{ds}{}^mC_{ds}T_{ds}G_{ds}T_{ds}{}^mC_{ds}T_{ks}G_{ks}A_k$ | 77 | 2843 |
| 1197176 | 2524 | 2539 | 123549 | 123564 | TGTCTCATGCCTTATA | $T_{ks}G_{ks}T_{ks}{}^mC_{ds}T_{ds}{}^mC_{ds}A_{ds}T_{ds}G_{ds}{}^mC_{ds}{}^mC_{ds}T_{ds}T_{ds}A_{ks}T_{ks}A_k$ | 17 | 2803 |
| 1197177 | 2526 | 2541 | 123551 | 123566 | ATTGTCTCATGCCTTA | $A_{ks}T_{ks}T_{ks}G_{ds}T_{ds}{}^mC_{ds}T_{ds}{}^mC_{ds}A_{ds}T_{ds}G_{ds}{}^mC_{ds}{}^mC_{ds}T_{ks}T_{ks}A_k$ | 15 | 2804 |
| 1197178 | 2527 | 2542 | 123552 | 123567 | AATTGTCTCATGCCTT | $A_{ks}A_{ks}T_{ks}T_{ds}G_{ds}T_{ds}{}^mC_{ds}T_{ds}{}^mC_{ds}A_{ds}T_{ds}G_{ds}{}^mC_{ds}{}^mC_{ks}T_{ks}T_k$ | 12 | 2805 |
| 1197179 | 2531 | 2546 | 123556 | 123571 | TGGAAATTGTCTCATG | $T_{ks}G_{ks}G_{ks}A_{ds}A_{ds}A_{ds}T_{ds}T_{ds}G_{ds}T_{ds}{}^mC_{ds}T_{ds}{}^mC_{ds}A_{ks}T_{ks}G_k$ | 16 | 2807 |
| 1197180 | 2532 | 2547 | 123557 | 123572 | ATGGAAATTGTCTCAT | $A_{ks}T_{ks}G_{ks}G_{ds}A_{ds}A_{ds}A_{ds}T_{ds}T_{ds}G_{ds}T_{ds}{}^mC_{ds}T_{ds}{}^mC_{ks}A_{ks}T_k$ | 47 | 2808 |
| 1197181 | 4595 | 4610 | 125620 | 125635 | TTACATTAGGAACAAG | $T_{ks}T_{ks}A_{ks}{}^mC_{ds}A_{ds}T_{ds}T_{ds}A_{ds}G_{ds}G_{ds}A_{ds}A_{ds}{}^mC_{ds}A_{ks}A_{ks}G_k$ | 87 | 2817 |
| 1197182 | 4597 | 4612 | 125622 | 125637 | TTTTACATTAGGAACA | $T_{ks}T_{ks}T_{ks}T_{ds}A_{ds}{}^mC_{ds}A_{ds}T_{ds}T_{ds}A_{ds}G_{ds}G_{ds}A_{ds}A_{ks}{}^mC_{ks}A_k$ | 115 | 2818 |
| 1197183 | 4599 | 4614 | 125624 | 125639 | ACTTTTACATTAGGAA | $A_{ks}{}^mC_{ks}T_{ks}T_{ds}T_{ds}T_{ds}A_{ds}{}^mC_{ds}A_{ds}T_{ds}T_{ds}A_{ds}G_{ds}G_{ks}A_{ks}A_k$ | 41 | 2819 |
| 1197184 | 4602 | 4617 | 125627 | 125642 | AGCACTTTTACATTAG | $A_{ks}G_{ks}{}^mC_{ks}A_{ds}{}^mC_{ds}T_{ds}T_{ds}T_{ds}T_{ds}A_{ds}{}^mC_{ds}A_{ds}T_{ds}T_{ks}A_{ks}G_k$ | 20 | 2820 |
| 1197185 | 4603 | 4618 | 125628 | 125643 | AAGCACTTTTACATTA | $A_{ks}A_{ks}G_{ks}{}^mC_{ds}A_{ds}{}^mC_{ds}T_{ds}T_{ds}T_{ds}T_{ds}A_{ds}{}^mC_{ds}A_{ds}T_{ks}T_{ks}A_k$ | 55 | 2821 |
| 1197186 | 4605 | 4620 | 125630 | 125645 | TTAAGCACTTTTACAT | $T_{ks}T_{ks}A_{ks}A_{ds}G_{ds}{}^mC_{ds}A_{ds}{}^mC_{ds}T_{ds}T_{ds}T_{ds}T_{ds}A_{ds}{}^mC_{ks}A_{ks}T_k$ | 65 | 2822 |
| 1197187 | 4795 | 4810 | 125820 | 125835 | GGAAGATCTGAAACTC | $G_{ks}G_{ks}A_{ks}A_{ds}G_{ds}A_{ds}T_{ds}{}^mC_{ds}T_{ds}G_{ds}A_{ds}A_{ds}A_{ds}{}^mC_{ks}T_{ks}{}^mC_k$ | 24 | 2823 |
| 1197188 | 4797 | 4812 | 125822 | 125837 | TTGGAAGATCTGAAAC | $T_{ks}T_{ks}G_{ks}G_{ds}A_{ds}A_{ds}G_{ds}A_{ds}T_{ds}{}^mC_{ds}T_{ds}G_{ds}A_{ds}A_{ks}A_{ks}{}^mC_k$ | 96 | 2824 |
| 1197189 | 4798 | 4813 | 125823 | 125838 | TTTGGAAGATCTGAAA | $T_{ks}T_{ks}T_{ks}G_{ds}G_{ds}A_{ds}A_{ds}G_{ds}A_{ds}T_{ds}{}^mC_{ds}T_{ds}G_{ds}A_{ks}A_{ks}A_k$ | 71 | 2825 |
| 1197190 | 4799 | 4814 | 125824 | 125839 | CTTTGGAAGATCTGAA | ${}^mC_{ks}T_{ks+1}T_{ks}T_{ds}G_{ds}G_{ds}A_{ds}A_{ds}G_{ds}A_{ds}T_{ds}{}^mC_{ds}T_{ds}G_{ks}A_{ks}A_k$ | 57 | 2826 |
| 1197191 | 4803 | 4818 | 125828 | 125843 | AGTGCTTTGGAAGATC | $A_{ks}G_{ks}T_{ks}G_{ds}{}^mC_{ds}T_{ds}T_{ds}T_{ds}G_{ds}G_{ds}A_{ds}A_{ds}G_{ds}A_{ks}T_{ks}{}^mC_k$ | 40 | 2828 |
| 1197192 | 4805 | 4820 | 125830 | 125845 | ATAGTGCTTTGGAAGA | $A_{ks}T_{ks}A_{ks}G_{ds}T_{ds}G_{ds}{}^mC_{ds}T_{ds}T_{ds}T_{ds}G_{ds}G_{ds}A_{ds}A_{ks}G_{ks}A_k$ | 39 | 2829 |
| 1197193 | N/A | N/A | 94729 | 94744 | AGGATGCATGGTTTTT | $A_{ks}G_{ks}A_{ds}T_{ds}G_{ds}{}^mC_{ds}A_{ds}T_{ds}G_{ds}G_{ds}T_{ds}T_{ds}T_{ks}T_{ks}T_k$ | 15 | 2830 |
| 1197194 | N/A | N/A | 94731 | 94746 | TTAGGATGCATGGTTT | $T_{ks}T_{ks}A_{ks}G_{ds}G_{ds}A_{ds}T_{ds}G_{ds}{}^mC_{ds}A_{ds}T_{ds}G_{ds}G_{ds}T_{ks}T_{ks}T_k$ | 37 | 2831 |
| 1197195 | N/A | N/A | 94732 | 94747 | TTTAGGATGCATGGTT | $T_{ks}T_{ks}T_{ks}A_{ds}G_{ds}G_{ds}A_{ds}T_{ds}G_{ds}{}^mC_{ds}A_{ds}T_{ds}G_{ds}G_{ks}T_{ks}T_k$ | 38 | 2832 |
| 1197196 | N/A | N/A | 94736 | 94751 | CAGATTTAGGATGCAT | ${}^mC_{ks}A_{ks}G_{ks}A_{ds}T_{ds}T_{ds}T_{ds}A_{ds}G_{ds}G_{ds}A_{ds}T_{ds}G_{ds}{}^mC_{ks}A_{ks}T_k$ | 27 | 2836 |
| 1197197 | N/A | N/A | 94737 | 94752 | TCAGATTTAGGATGCA | $T_{ks}{}^mC_{ks}A_{ks}G_{ds}A_{ds}T_{ds}T_{ds}T_{ds}A_{ds}G_{ds}G_{ds}A_{ds}T_{ds}G_{ks}{}^mC_{ks}A_k$ | 20 | 2837 |
| 1197198 | N/A | N/A | 94739 | 94754 | ATTCAGATTTAGGATG | $A_{ks}T_{ks}T_{ks}{}^mC_{ds}A_{ds}G_{ds}A_{ds}T_{ds}T_{ds}T_{ds+1}A_{ds}G_{ds}G_{ds}A_{ks}T_{ks}G_k$ | 139 | 2838 |
| 1197206 | N/A | N/A | 117327 | 117342 | ATATTGCAATCTGTCT | $A_{ks}T_{ks}A_{ks}T_{ds}T_{ds}G_{ds}{}^mC_{ds}A_{ds}A_{ds}T_{ds}{}^mC_{ds}T_{ds}G_{ds}T_{ks}{}^mC_{ks}T_k$ | 63 | 2844 |
| 1197207 | N/A | N/A | 117328 | 117343 | AATATTGCAATCTGTC | $A_{ks}A_{ks}T_{ks}A_{ds}T_{ds}T_{ds}G_{ds}{}^mC_{ds}A_{ds}A_{ds}T_{ds}{}^mC_{ds}T_{ds}G_{ks}T_{ks}{}^mC_k$ | 51 | 2845 |
| 1197208 | N/A | N/A | 117329 | 117344 | TAATATTGCAATCTGT | $T_{ks}A_{ks}A_{ks}T_{ds}A_{ds}T_{ds}T_{ds}G_{ds}{}^mC_{ds}A_{ds}A_{ds}T_{ds}{}^mC_{ds}T_{ks}G_{ks}T_k$ | 66 | 2846 |
| 1197209 | N/A | N/A | 117331 | 117346 | TGTAATATTGCAATCT | $T_{ks}G_{ks}T_{ks}A_{ds}A_{ds}T_{ds}A_{ds}T_{ds}T_{ds}G_{ds}{}^mC_{ds}A_{ds}A_{ds}T_{ks}{}^mC_{ks}T_k$ | 33 | 2847 |
| 1197210 | N/A | N/A | 117332 | 117347 | ATGTAATATTGCAATC | $A_{ks}T_{ks}G_{ks}T_{ds}A_{ds}A_{ds}T_{ds}A_{ds}T_{ds}T_{ds}G_{ds}{}^mC_{ds}A_{ds}A_{ks}T_{ks}{}^mC_k$ | 105 | 2848 |
| 1197211 | N/A | N/A | 117333 | 117348 | TATGTAATATTGCAAT | $T_{ks}A_{ks}T_{ks}G_{ds}T_{ds}A_{ds}A_{ds}T_{ds}A_{ds}T_{ds}T_{ds}G_{ds}{}^mC_{ds}A_{ks}A_{ks}T_k$ | 80 | 2849 |
| 1197212 | N/A | N/A | 117335 | 117350 | TTTATGTAATATTGCA | $T_{ks}T_{ks}T_{ks}A_{ds}T_{ds}G_{ds}T_{ds}A_{ds}A_{ds}T_{ds}A_{ds}T_{ds}T_{ds}G_{ks}{}^mC_{ks}A_k$ | 55 | 2850 |
| 1197220 | N/A | N/A | 119667 | 119682 | TAAGGTTTCCCAGATT | $T_{ks}A_{ks}A_{ks}G_{ds}G_{ds}T_{ds}T_{ds}T_{ds}{}^mC_{ds}{}^mC_{ds}{}^mC_{ds}A_{ds}G_{ds}A_{ks}T_{ks}T_k$ | 32 | 2851 |
| 1197221 | N/A | N/A | 119669 | 119684 | AGTAAGGTTTCCCAGA | $A_{ks}G_{ks}T_{ks}A_{ds}A_{ds}G_{ds}G_{ds}T_{ds}T_{ds}T_{ds}{}^mC_{ds}{}^mC_{ds}{}^mC_{ds}A_{ks}G_{ks}A_k$ | 42 | 2852 |
| 1197222 | N/A | N/A | 119670 | 119685 | AAGTAAGGTTTCCCAG | $A_{ks}A_{ks}G_{ks}T_{ds}A_{ds}A_{ds}G_{ds}G_{ds}T_{ds}T_{ds}T_{ds}{}^mC_{ds}{}^mC_{ds}{}^mC_{ks}A_{ks}G_k$ | 40 | 2853 |
| 1197223 | N/A | N/A | 119671 | 119686 | TAAGTAAGGTTTCCCA | $T_{ks}A_{ks}A_{ks}G_{ds}T_{ds}A_{ds}A_{ds}G_{ds}G_{ds}T_{ds}T_{ds}T_{ds}{}^mC_{ks}{}^mC_{ks}A_k$ | 11 | 2854 |

Table 47-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1197224 | N/A | N/A | 119673 | 119688 | ACTAAGTAAGGTTTCC | $A_{ks}{}^mC_{ks}T_{ks}A_{ds}A_{ds}G_{ds}T_{ds}A_{ds}A_{ds}G_{ds}G_{ds}T_{ds}T_{ds}T_{ks}{}^mC_{ks}{}^mC_k$ | 24 | 2855 |
| 1197225 | N/A | N/A | 119674 | 119689 | GACTAAGTAAGGTTTC | $G_{ks}A_{ks}{}^mC_{ks}T_{ds}A_{ds}A_{ds}G_{ds}T_{ds}A_{ds}A_{ds}G_{ds}G_{ds}T_{ds}T_{ks}T_{ks}{}^mC_k$ | 46 | 2856 |
| 1197226 | N/A | N/A | 119675 | 119690 | AGACTAAGTAAGGTTT | $A_{ks}G_{ks}A_{ks}{}^mC_{ds}T_{ds}A_{ds}A_{ds}G_{ds}T_{ds}A_{ds}A_{ds}G_{ds}G_{ds}T_{ks}T_{ks}T_k$ | 67 | 2857 |
| 1197227 | N/A | N/A | 119677 | 119692 | TTAGACTAAGTAAGGT | $T_{ks}T_{ks}A_{ds}G_{ds}A_{ds}{}^mC_{ds}T_{ds}A_{ds}A_{ds}G_{ds}T_{ds}A_{ds}A_{ds}G_{ks}G_{ks}T_k$ | 64 | 2858 |
| 1198858 | N/A | N/A | 115908 | 115923 | CTCTTATATGGTTTTG | ${}^mC_{ks}T_{ks}{}^mC_{ds}T_{ds}T_{ds}A_{ds}T_{ds}A_{ds}T_{ds}G_{ds}G_{ds}T_{ks}T_{es}T_{ks}G_k$ | 29 | 2842 |
| 1198859 | N/A | N/A | 115909 | 115924 | ACTCTTATATGGTTTT | $A_{ks}{}^mC_{ks}T_{ds}{}^mC_{ds}T_{ds}T_{ds}A_{ds}T_{ds}A_{ds}T_{ds}G_{ds}G_{ks}T_{es}T_{ks}T_{es}T_k$ | 33 | 2859 |
| 1198860 | N/A | N/A | 115910 | 115925 | AACTCTTATATGGTTT | $A_{ks}A_{ks}{}^mC_{ds}T_{ds}{}^mC_{ds}T_{ds}T_{ds}A_{ds}T_{ds}A_{ds}T_{ds}G_{ks}G_{ds}T_{ks}T_{es}T_k$ | 82 | 2860 |
| 1198861 | N/A | N/A | 115911 | 115926 | CAACTCTTATATGGTT | ${}^mC_{ks}A_{ds}{}^mC_{ds}T_{ds}{}^mC_{ds}T_{ds}T_{ds}A_{ds}T_{ds}A_{ds}T_{ks}G_{es}G_{ks}T_{es}T_k$ | 100 | 2861 |
| 1198862 | N/A | N/A | 115913 | 115928 | GACAACTCTTATATGG | $G_{ks}A_{ks}{}^mC_{ds}A_{ds}A_{ds}{}^mC_{ds}T_{ds}{}^mC_{ds}T_{ds}T_{ds}A_{ds}T_{ks}A_{es}T_{ks}G_{es}G_k$ | 72 | 2862 |
| 1198872 | N/A | N/A | 117755 | 117770 | TGTATGTCAGAAGAGT | $T_{ks}G_{ks}T_{ds}A_{ds}T_{ds}G_{ds}T_{ds}{}^mC_{ds}A_{ds}G_{ds}A_{ds}A_{es}G_{es}A_{ks}G_{es}T_k$ | 8 | 2863 |
| 1198873 | N/A | N/A | 117757 | 117772 | AGTGTATGTCAGAAGA | $A_{ks}G_{ks}T_{ds}G_{ds}T_{ds}A_{ds}T_{ds}G_{ds}T_{ds}{}^mC_{ds}A_{ds}G_{ks}A_{es}A_{ks}G_{es}A_k$ | 4 | 2864 |
| 1198874 | N/A | N/A | 117758 | 117773 | AAGTGTATGTCAGAAG | $A_{ks}A_{ks}G_{ds}T_{ds}G_{ds}T_{ds}A_{ds}T_{ds}G_{ds}T_{ds}{}^mC_{ds}A_{ks}G_{es}A_{ks}A_{es}G_k$ | 2 | 2865 |
| 1198875 | N/A | N/A | 117759 | 117774 | AAAGTGTATGTCAGAA | $A_{ks}A_{ks}A_{ds}G_{ds}T_{ds}G_{ds}T_{ds}A_{ds}T_{ds}G_{ds}T_{ds}{}^mC_{ks}A_{es}G_{ks}A_{es}A_k$ | 5 | 2866 |
| 1198876 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{ks}{}^mC_{es}A_{ks}G_{es}A_k$ | 31 | 2867 |
| 1198877 | N/A | N/A | 117761 | 117776 | TTAAAGTGTATGTCAG | $T_{ks}T_{ks}A_{ds}A_{ds}A_{ds}G_{ds}T_{ds}G_{ds}T_{ds}A_{ds}T_{ds}G_{ks}T_{es}{}^mC_{ks}A_{es}G_k$ | 11 | 2868 |
| 1198878 | N/A | N/A | 117762 | 117777 | TTTAAAGTGTATGTCA | $T_{ks}T_{ks}T_{ds}A_{ds}A_{ds}A_{ds}G_{ds}T_{ds}G_{ds}T_{ds}A_{ds}T_{ks}G_{es}T_{ks}{}^mC_{es}A_k$ | 42 | 2869 |
| 1198879 | N/A | N/A | 117763 | 117778 | CTTTAAAGTGTATGTC | ${}^mC_{ks}T_{ks}T_{ds}T_{ds}A_{ds}A_{ds}A_{ds}G_{ds}T_{ds}G_{ds}T_{ds}A_{ks}T_{es}G_{ks}T_{es}{}^mC_k$ | 29 | 1634 |
| 1198880 | N/A | N/A | 117765 | 117780 | AACTTTAAAGTGTATG | $A_{ks}A_{ks}{}^mC_{ds}T_{ds}T_{ds}T_{ds}A_{ds}A_{ds}A_{ds}G_{ds}T_{ds}G_{ks}T_{es}A_{ks}T_{es}G_k$ | 98 | 2870 |

Table 48

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 34 | 52 |
| 716524 | 4443 | 4458 | 125468 | 125483 | ACTGAGGTATAACTGG | $A_{ks}{}^mC_{ks}T_{ks}G_{ds}A_{ds}G_{ds}G_{ds}T_{ds}A_{ds}T_{ds}A_{ds}A_{ds}{}^mC_{ds}T_{ks}G_{ks}G_k$ | 59 | 392 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 15 | 810 |
| 958590 | 4439 | 4454 | 125464 | 125479 | AGGTATAACTGGGCAA | $A_{ks}G_{ks}G_{ks}T_{ds}A_{ds}T_{ds}A_{ds}A_{ds}{}^mC_{ds}T_{ds}G_{ds}G_{ds}G_{ds}{}^mC_{ks}A_{ks}A_k$ | 18 | 905 |
| 1009395 | 4442 | 4457 | 125467 | 125482 | CTGAGGTATAACTGGG | ${}^mC_{ks}T_{ks}G_{ks}A_{ds}G_{ds}G_{ds}T_{ds}A_{ds}T_{ds}A_{ds}A_{ds}{}^mC_{ds}T_{ks}G_{ks}G_k$ | 43 | 2801 |
| 1009396 | 4444 | 4459 | 106028 125469 | 106043 125484 | CACTGAGGTATAACTG | ${}^mC_{ks}A_{ks}{}^mC_{ks}T_{ds}G_{ds}A_{ds}G_{ds}G_{ds}T_{ds}A_{ds}T_{ds}A_{ds}{}^mC_{ks}T_{ks}G_k$ | 41 | 2802 |
| 1009397 | 4446 | 4461 | 106030 125471 | 106045 125486 | AACACTGAGGTATAAC | $A_{ks}A_{ks}{}^mC_{ks}A_{ds}{}^mC_{ds}T_{ds}G_{ds}A_{ds}G_{ds}G_{ds}T_{ds}A_{ks}T_{ks}A_{ks}{}^mC_k$ | 44 | 2816 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 20 | 2800 |
| 1074726 | 4438 | 4453 | 125463 | 125478 | GGTATAACTGGGCAAA | $G_{ks}G_{ks}T_{ks}A_{ds}T_{ds}A_{ds}A_{ds}{}^mC_{ds}T_{ds}G_{ds}G_{ds}G_{ds}{}^mC_{ks}A_{ks}A_k$ | 23 | 1427 |
| 1074727 | 4440 | 4455 | 125465 | 125480 | GAGGTATAACTGGGCA | $G_{ks}A_{ks}G_{ks}G_{ds}T_{ds}A_{ds}T_{ds}A_{ds}A_{ds}{}^mC_{ds}T_{ds}G_{ds}G_{ds}G_{ks}{}^mC_{ks}A_k$ | 51 | 1503 |
| 1074728 | 4441 | 4456 | 125466 | 125481 | TGAGGTATAACTGGGC | $T_{ks}G_{ks}A_{ks}G_{ds}G_{ds}T_{ds}A_{ds}T_{ds}A_{ds}A_{ds}{}^mC_{ds}T_{ds}G_{ks}G_{ks}G_{ks}{}^mC_k$ | 14 | 1580 |

Table 48-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1076439 | N/A | N/A | 115906 | 115921 | CTTATATGGTTTTGTG | $^mC_{ks}T_{ks}T_{ks}A_{ds}T_{ds}A_{ds}T_{ds}G_{ds}G_{ds}T_{ds}T_{ds}T_{ds}G_{ks}T_{ks}G_k$ | 31 | 2788 |
| 1076456 | N/A | N/A | 117763 | 117778 | CTTTAAAGTGTATGTC | $^mC_{ks}T_{ks}T_{ks}T_{ds}A_{ds}A_{ds}A_{ds}G_{ds}G_{ds}T_{ds}A_{ds}T_{ds}G_{ks}T_{ks}{^mC_k}$ | 44 | 1634 |
| 1097224 | N/A | N/A | 115908 | 115923 | CTCTTATATGGTTTTG | $^mC_{ks}T_{ks}{^mC_{ks}}T_{ds}T_{ds}A_{ds}T_{ds}A_{ds}T_{ds}G_{ds}G_{ds}T_{ds}T_{ds}T_{ks}T_{ks}G_k$ | 22 | 2842 |
| 1097247 | N/A | N/A | 117760 | 117775 | TAAAGTGTATGTCAGA | $T_{ks}A_{ks}A_{ds}A_{ds}G_{ds}T_{ds}G_{ds}T_{ds}A_{ds}T_{ds}G_{ds}T_{ds}{^mC_{ds}}A_{ks}G_{ks}A_k$ | 9 | 2867 |
| 1197199 | N/A | N/A | 115903 | 115918 | ATATGGTTTTGTGTGT | $A_{ks}T_{ks}A_{ds}T_{ds}G_{ds}G_{ds}T_{ds}T_{ds}T_{ds}T_{ds}G_{ds}T_{ds}G_{ds}T_{ks}G_{ks}T_k$ | 75 | 2839 |
| 1197200 | N/A | N/A | 115905 | 115920 | TTATATGGTTTTGTGT | $T_{ks}T_{ks}A_{ds}T_{ds}A_{ds}T_{ds}G_{ds}G_{ds}T_{ds}T_{ds}T_{ds}T_{ds}G_{ds}T_{ks}G_{ks}T_k$ | 49 | 2840 |
| 1197201 | N/A | N/A | 115907 | 115922 | TCTTATATGGTTTTGT | $T_{ks}{^mC_{ks}}T_{ks}T_{ds}A_{ds}T_{ds}A_{ds}T_{ds}G_{ds}G_{ds}T_{ds}T_{ds}T_{ds}T_{ks}G_{ks}T_k$ | 46 | 2841 |
| 1197202 | N/A | N/A | 115909 | 115924 | ACTCTTATATGGTTTT | $A_{ks}{^mC_{ks}}T_{ks}{^mC_{ds}}T_{ds}T_{ds}A_{ds}T_{ds}A_{ds}T_{ds}G_{ds}G_{ds}T_{ds}T_{ks}T_{ks}T_k$ | 27 | 2859 |
| 1197203 | N/A | N/A | 115910 | 115925 | AACTCTTATATGGTTT | $A_{ks}A_{ks}{^mC_{ks}}T_{ds}{^mC_{ds}}T_{ds}T_{ds}A_{ds}T_{ds}A_{ds}T_{ds}G_{ds}G_{ds}T_{ks}T_{ks}T_k$ | 68 | 2860 |
| 1197204 | N/A | N/A | 115911 | 115926 | CAACTCTTATATGGTT | $^mC_{ks}A_{ks}A_{ks}{^mC_{ds}}T_{ds}{^mC_{ds}}T_{ds}T_{ds}A_{ds}T_{ds}A_{ds}T_{ds}G_{ds}G_{ks}T_{ks}T_k$ | 89 | 2861 |
| 1197205 | N/A | N/A | 115913 | 115928 | GACAACTCTTATATGG | $G_{ks}A_{ks}{^mC_{ks}}A_{ds}A_{ds}{^mC_{ds}}T_{ds}{^mC_{ds}}T_{ds}T_{ds}A_{ds}T_{ds}A_{ds}T_{ks}G_{ks}G_k$ | 67 | 2862 |
| 1197213 | N/A | N/A | 117755 | 117770 | TGTATGTCAGAAGAGT | $T_{ks}G_{ks}T_{ks}A_{ds}T_{ds}G_{ds}T_{ds}{^mC_{ds}}A_{ds}G_{ds}A_{ds}A_{ds}G_{ds}A_{ks}G_{ks}T_k$ | 5 | 2863 |
| 1197214 | N/A | N/A | 117757 | 117772 | AGTGTATGTCAGAAGA | $A_{ks}G_{ks}T_{ks}G_{ds}T_{ds}A_{ds}T_{ds}G_{ds}T_{ds}{^mC_{ds}}A_{ds}G_{ds}A_{ds}A_{ks}G_{ks}A_k$ | 5 | 2864 |
| 1197215 | N/A | N/A | 117758 | 117773 | AAGTGTATGTCAGAAG | $A_{ks}A_{ks}G_{ks}T_{ds}G_{ds}T_{ds}A_{ds}T_{ds}G_{ds}T_{ds}{^mC_{ds}}A_{ds}G_{ds}A_{ks}A_{ks}G_k$ | 13 | 2865 |
| 1197216 | N/A | N/A | 117759 | 117774 | AAAGTGTATGTCAGAA | $A_{ks}A_{ks}A_{ks}G_{ds}T_{ds}G_{ds}T_{ds}A_{ds}T_{ds}G_{ds}T_{ds}{^mC_{ds}}A_{ds}A_{ks}A_{ks}A_k$ | 12 | 2866 |
| 1197217 | N/A | N/A | 117761 | 117776 | TTAAAGTGTATGTCAG | $T_{ks}T_{ks}A_{ks}A_{ds}A_{ds}G_{ds}T_{ds}G_{ds}T_{ds}A_{ds}T_{ds}G_{ds}T_{ds}{^mC_{ks}}A_{ks}G_k$ | 8 | 2868 |
| 1197218 | N/A | N/A | 117762 | 117777 | TTTAAAGTGTATGTCA | $T_{ks}T_{ks}T_{ks}A_{ds}A_{ds}A_{ds}G_{ds}T_{ds}G_{ds}T_{ds}A_{ds}T_{ds}G_{ds}T_{ks}{^mC_{ks}}A_k$ | 29 | 2869 |
| 1197219 | N/A | N/A | 117765 | 117780 | AACTTTAAAGTGTATG | $A_{ks}A_{ks}{^mC_{ks}}T_{ds}T_{ds}T_{ds}A_{ds}A_{ds}A_{ds}G_{ds}T_{ds}G_{ds}T_{ds}A_{ks}T_{ks}G_k$ | 71 | 2870 |
| 1198284 | 2524 | 2539 | 123549 | 123564 | TGTCTCATGCCTTATA | $T_{ks}G_{ks}T_{ks}{^mC_{ds}}T_{ds}{^mC_{ds}}A_{ds}T_{ds}G_{ds}{^mC_{ds}}{^mC_{ds}}T_{ds}T_{ds}A_{es}T_{ks}A_e$ | 27 | 2803 |
| 1198285 | 2526 | 2541 | 123551 | 123566 | ATTGTCTCATGCCTTA | $A_{ks}T_{ks}T_{ks}G_{ds}T_{ds}{^mC_{ds}}T_{ds}{^mC_{ds}}A_{ds}T_{ds}G_{ds}{^mC_{ds}}{^mC_{ks}}T_{es}T_{ks}A_e$ | 13 | 2804 |
| 1198286 | 2527 | 2542 | 123552 | 123567 | AATTGTCTCATGCCTT | $A_{ks}A_{ks}T_{ks}T_{ds}G_{ds}T_{ds}{^mC_{ds}}T_{ds}{^mC_{ds}}A_{ds}T_{ds}G_{ds}{^mC_{ks}}{^mC_{es}}T_{ks}T_e$ | 17 | 2805 |
| 1198287 | 2528 | 2543 | 123553 | 123568 | AAATTGTCTCATGCCT | $A_{ks}A_{ks}A_{ks}T_{ds}T_{ds}G_{ds}T_{ds}{^mC_{ds}}T_{ds}{^mC_{ds}}A_{ds}T_{ds}G_{ks}{^mC_{es}}{^mC_{ks}}T_e$ | 13 | 443 |
| 1198288 | 2529 | 2544 | 123554 | 123569 | GAAATTGTCTCATGCC | $G_{ks}A_{ks}A_{ks}A_{ds}T_{ds}T_{ds}G_{ds}T_{ds}{^mC_{ds}}T_{ds}{^mC_{ds}}A_{ds}T_{ks}G_{es}{^mC_{ks}}{^mC_e}$ | 10 | 2800 |
| 1198289 | 2530 | 2545 | 123555 | 123570 | GGAAATTGTCTCATGC | $G_{ks}G_{ks}A_{ks}A_{ds}A_{ds}T_{ds}T_{ds}G_{ds}T_{ds}{^mC_{ds}}T_{ds}{^mC_{ds}}A_{ks}T_{es}G_{ks}{^mC_e}$ | 12 | 2806 |
| 1198290 | 2531 | 2546 | 123556 | 123571 | TGGAAATTGTCTCATG | $T_{ks}G_{ks}G_{ks}A_{ds}A_{ds}A_{ds}T_{ds}T_{ds}G_{ds}T_{ds}{^mC_{ds}}T_{ds}{^mC_{ds}}A_{ks}T_{es}G_e$ | 15 | 2807 |
| 1198291 | 2532 | 2547 | 123557 | 123572 | ATGGAAATTGTCTCAT | $A_{ks}T_{ks}G_{ks}G_{ds}A_{ds}A_{ds}A_{ds}T_{ds}T_{ds}G_{ds}T_{ds}{^mC_{ds}}T_{ks}{^mC_{es}}A_{ks}T_e$ | 58 | 2808 |
| 1198292 | 2534 | 2549 | 123559 | 123574 | ATATGGAAATTGTCTC | $A_{ks}T_{ks}A_{ks}T_{ds}G_{ds}G_{ds}A_{ds}A_{ds}A_{ds}T_{ds}T_{ds}G_{ks}{^mC_{es}}T_{ks}{^mC_e}$ | 58 | 656 |
| 1198293 | 2560 | 2575 | 123585 | 123600 | AGTATGTGGCAATAAT | $A_{ks}G_{ks}T_{ks}A_{ds}T_{ds}G_{ds}T_{ds}G_{ds}G_{ds}{^mC_{ds}}A_{ds}A_{ds}T_{es}A_{ks}T_e$ | 25 | 2809 |
| 1198294 | 2562 | 2577 | 123587 | 123602 | AGAGTATGTGGCAATA | $A_{ks}G_{ks}A_{ks}G_{ds}T_{ds}A_{ds}T_{ds}G_{ds}T_{ds}G_{ds}{^mC_{ds}}A_{es}A_{ks}T_{ks}A_e$ | 13 | 2810 |
| 1198295 | 2563 | 2578 | 123588 | 123603 | TAGAGTATGTGGCAAT | $T_{ks}A_{ks}G_{ds}A_{ds}G_{ds}T_{ds}A_{ds}T_{ds}G_{ds}T_{ds}G_{ds}{^mC_{ks}}A_{es}A_{ks}T_e$ | 15 | 2811 |
| 1198296 | 2564 | 2579 | 123589 | 123604 | TTAGAGTATGTGGCAA | $T_{ks}T_{ks}A_{ks}G_{ds}A_{ds}G_{ds}T_{ds}A_{ds}T_{ds}G_{ds}T_{ds}G_{ks}{^mC_{es}}A_{ks}A_e$ | 29 | 963 |
| 1198297 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ks}G_{es}{^mC_{ks}}A_e$ | 8 | 810 |
| 1198298 | 2566 | 2581 | 123591 | 123606 | TATTAGAGTATGTGGC | $T_{ks}A_{ks}T_{ks}T_{ds}A_{ds}G_{ds}A_{ds}G_{ds}T_{ds}A_{ds}T_{ds}G_{ds}T_{ks}G_{es}G_{ks}{^mC_e}$ | 23 | 2812 |
| 1198299 | 2567 | 2582 | 123592 | 123607 | ATATTAGAGTATGTGG | $A_{ks}A_{ks}T_{ds}T_{ds}A_{ds}G_{ds}A_{ds}G_{ds}T_{ds}A_{ds}T_{ds}G_{ks}T_{es}G_{ks}G_e$ | 27 | 2813 |
| 1198300 | 2568 | 2583 | 123593 | 123608 | TATATTAGAGTATGTG | $T_{ks}A_{ks}T_{ks}A_{ds}T_{ds}T_{ds}A_{ds}G_{ds}A_{ds}G_{ds}T_{ds}A_{ds}T_{ks}G_{es}T_{ks}G_e$ | 60 | 2814 |
| 1198301 | 2570 | 2585 | 123595 | 123610 | TCTATATTAGAGTATG | $T_{ks}{^mC_{ks}}T_{ks}A_{ds}T_{ds}A_{ds}T_{ds}T_{ds}A_{ds}G_{ds}A_{ds}G_{ks}T_{es}A_{ks}T_{ks}G_e$ | 43 | 887 |

Table 48-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1198307 | 4595 | 4610 | 125620 | 125635 | TTACATTAGGAACAAG | $T_{ks}T_{ks}A_{ks}{}^mC_{ds}A_{ds}T_{ds}T_{ds}A_{ds}G_{ds}G_{ds}A_{ds}A_{ds}{}^mC_{ks}A_{es}A_{ks}G_e$ | 49 | 2817 |
| 1198308 | 4597 | 4612 | 125622 | 125637 | TTTTACATTAGGAACA | $T_{ks}T_{ks}T_{ks}T_{ds}A_{ds}{}^mC_{ds}A_{ds}T_{ds}T_{ds}A_{ds}G_{ds}G_{ds}A_{ks}A_e{}^mC_{ks}A_e$ | 68 | 2818 |
| 1198309 | 4598 | 4613 | 125623 | 125638 | CTTTTACATTAGGAAC | ${}^mC_{ks}T_{ks}T_{ks}T_{ds}T_{ds}A_{ds}{}^mC_{ds}A_{ds}T_{ds}T_{ds}A_{ds}G_{ds}G_{ks}A_{es}A_{ks}{}^mC_e$ | 85 | 1124 |
| 1198310 | 4599 | 4614 | 125624 | 125639 | ACTTTTACATTAGGAA | $A_{ks}{}^mC_{ks}T_{ks}T_{ds}T_{ds}T_{ds}A_{ds}{}^mC_{ds}A_{ds}T_{ds}T_{ds}A_{ds}G_{ks}G_{es}A_{ks}A_e$ | 28 | 2819 |
| 1198311 | 4600 | 4615 | 125625 | 125640 | CACTTTTACATTAGGA | ${}^mC_{ks}A_{ks}{}^mC_{ks}T_{ds}T_{ds}T_{ds}T_{ds}A_{ds}{}^mC_{ds}A_{ds}T_{ds}T_{ds}A_{ks}G_{es}G_{ks}A_e$ | 39 | 1200 |
| 1198312 | 4601 | 4616 | 125626 | 125641 | GCACTTTTACATTAGG | $G_{ks}{}^mC_{ks}A_{ks}{}^mC_{ds}T_{ds}T_{ds}T_{ds}T_{ds}A_{ds}{}^m C_{ds}A_{ds}T_{ds}T_{ks}A_{es}G_{ks}G_e$ | 7 | 1276 |
| 1198313 | 4602 | 4617 | 125627 | 125642 | AGCACTTTTACATTAG | $A_{ks}G_{ks}{}^mC_{ks}A_{ds}{}^mC_{ds}T_{ds}T_{ds}T_{ds}T_{ds}A_{ds}{}^mC_{ds}A_{ds}T_{ks}T_{es}A_{ks}G_e$ | 31 | 2820 |
| 1198314 | 4603 | 4618 | 125628 | 125643 | AAGCACTTTTACATTA | $A_{ks}A_{ks}G_{ks}{}^mC_{ds}A_{ds}{}^mC_{ds}T_{ds}T_{ds}T_{ds}T_{ds}A_{ds}{}^mC_{ds}A_{ks}T_{es}T_{ks}A_e$ | 82 | 2821 |
| 1198315 | 4605 | 4620 | 125630 | 125645 | TTAAGCACTTTTACAT | $T_{ks}T_{ks}A_{ks}A_{ds}G_{ds}{}^mC_{ds}A_{ds}{}^mC_{ds}T_{ds}T_{ds}T_{ds}T_{ds}A_{ks}{}^mC_{es}A_{ks}T_e$ | 85 | 2822 |
| 1198316 | 4795 | 4810 | 125820 | 125835 | GGAAGATCTGAAACTC | $G_{ks}G_{ks}A_{ks}A_{ds}G_{ds}A_{ds}T_{ds}{}^mC_{ds}T_{ds}G_{ds}A_{ds}A_{ds}A_{ks}{}^mC_{es}T_{ks}{}^mC_e$ | 49 | 2823 |
| 1198317 | 4797 | 4812 | 125822 | 125837 | TTGGAAGATCTGAAAC | $T_{ks}T_{ks}G_{ks}G_{ds}A_{ds}A_{ds}G_{ds}A_{ds}T_{ds}{}^mC_{ds}T_{ds}G_{ds}A_{ks}A_e A_{ks}{}^mC_e$ | 74 | 2824 |
| 1198318 | 4798 | 4813 | 125823 | 125838 | TTTGGAAGATCTGAAA | $T_{ks}T_{ks}T_{ks}G_{ds}G_{ds}A_{ds}A_{ds}G_{ds}A_{ds}T_{ds}{}^mC_{ds}T_{ds}G_{ks}A_{es}A_{ks}A_e$ | 120 | 2825 |
| 1198319 | 4799 | 4814 | 125824 | 125839 | CTTTGGAAGATCTGAA | ${}^mC_{ks}T_{ks}T_{ks}T_{ds}G_{ds}G_{ds}A_{ds}A_{ds}G_{ds}A_{ds}T_{ds}{}^mC_{ds}T_{ks}G_{es}A_{ks}A_e$ | 47 | 2826 |
| 1198320 | 4800 | 4815 | 125825 | 125840 | GCTTTGGAAGATCTGA | $G_{ks}{}^mC_{ks}T_{ks}T_{ds}T_{ds}G_{ds}G_{ds}A_{ds}A_{ds}G_{ds}A_{ds}T_{ds}{}^mC_{ks}T_{es}G_{ks}A_e$ | 26 | 2044 |
| 1198321 | 4801 | 4816 | 125826 | 125841 | TGCTTTGGAAGATCTG | $T_{ks}G_{ks}{}^mC_{ks}T_{ds}T_{ds}T_{ds}G_{ds}G_{ds}A_{ds}A_{ds}G_{ds}A_{ds}T_{ks}{}^mC_{es}T_{ks}G_e$ | 45 | 2121 |
| 1198322 | 4802 | 4817 | 125827 | 125842 | GTGCTTTGGAAGATCT | $G_{ks}T_{ks}G_{ks}{}^mC_{ds}T_{ds}T_{ds}T_{ds}G_{ds}G_{ds}A_{ds}A_{ds}G_{ds}A_{ks}T_{es}{}^mC_{ks}T_e$ | 48 | 2827 |
| 1198323 | 4803 | 4818 | 125828 | 125843 | AGTGCTTTGGAAGATC | $A_{ks}G_{ks}T_{ks}G_{ds}{}^mC_{ds}T_{ds}T_{ds}T_{ds}G_{ds}G_{ds}A_{ds}A_{ds}G_{ks}A_{es}T_{ks}{}^mC_e$ | 32 | 2828 |
| 1198324 | 4805 | 4820 | 125830 | 125845 | ATAGTGCTTTGGAAGA | $A_{ks}T_{ks}A_{ks}G_{ds}T_{ds}G_{ds}{}^mC_{ds}T_{ds}T_{ds}T_{ds}G_{ds}G_{ds}A_{ks}A_{es}G_{ks}A_e$ | 53 | 2829 |
| 1198325 | N/A | N/A | 94729 | 94744 | AGGATGCATGGTTTTT | $A_{ks}G_{ks}G_{ks}A_{ds}T_{ds}G_{ds}{}^mC_{ds}A_{ds}T_{ds}G_{ds}G_{ds}T_{ks}T_{es}T_{ks}T_e$ | 34 | 2830 |
| 1198326 | N/A | N/A | 94731 | 94746 | TTAGGATGCATGGTTT | $T_{ks}T_{ks}A_{ks}G_{ds}G_{ds}A_{ds}T_{ds}G_{ds}{}^mC_{ds}A_{ds}T_{ds}G_{ds}G_{ks}T_{es}T_{ks}T_e$ | 84 | 2831 |
| 1198327 | N/A | N/A | 94732 | 94747 | TTTAGGATGCATGGTT | $T_{ks}T_{ks}T_{ks}A_{ds}G_{ds}G_{ds}A_{ds}T_{ds}G_{ds}{}^mC_{ds}A_{ds}T_{ds}G_{ks}G_{es}T_{ks}T_e$ | 29 | 2832 |
| 1198328 | N/A | N/A | 94733 | 94748 | ATTTAGGATGCATGGT | $A_{ks}T_{ks}T_{ks}T_{ds}A_{ds}G_{ds}G_{ds}A_{ds}T_{ds}G_{ds}{}^mC_{ds}A_{ds}T_{ks}G_{es}G_{ks}T_e$ | 42 | 2833 |
| 1198329 | N/A | N/A | 94734 | 94749 | GATTTAGGATGCATGG | $G_{ks}A_{ks}T_{ks}T_{ds}T_{ds}A_{ds}G_{ds}G_{ds}A_{ds}T_{ds}G_{ds}{}^mC_{ds}A_{ks}T_{es}G_{ks}G_e$ | 36 | 2834 |
| 1198330 | N/A | N/A | 94735 | 94750 | AGATTTAGGATGCATG | $A_{ks}G_{ks}A_{ks}T_{ds}T_{ds}T_{ds}A_{ds}G_{ds}G_{ds}A_{ds}T_{ds}G_{ds}{}^mC_{ks}A_{es}T_{ks}G_e$ | 27 | 2934 |
| 1198331 | N/A | N/A | 94736 | 94751 | CAGATTTAGGATGCAT | ${}^mC_{ks}A_{ks}G_{ks}A_{ds}T_{ds}T_{ds}T_{ds}A_{ds}G_{ds}G_{ds}A_{ds}T_{ds}G_{ks}{}^mC_{es}A_{ks}T_e$ | 26 | 2836 |
| 1198332 | N/A | N/A | 94737 | 94752 | TCAGATTTAGGATGCA | $T_{ks}{}^mC_{ks}A_{ks}G_{ds}A_{ds}T_{ds}T_{ds}T_{ds}A_{ds}G_{ds}G_{ds}A_{ds}T_{ks}G_{es}{}^mC_{ks}A_e$ | 58 | 2837 |
| 1198333 | N/A | N/A | 94739 | 94754 | ATTCAGATTTAGGATG | $A_{ks}T_{ks}T_{ks}{}^mC_{ds}A_{ds}G_{ds}A_{ds}T_{ds}T_{ds}T_{ds}A_{ds}G_{ds}G_{ks}A_{es}T_{ks}G_e$ | 77 | 2838 |
| 1198343 | N/A | N/A | 117325 | 117340 | ATTGCAATCTGTCTGA | $A_{ks}T_{ks}T_{ks}G_{ds}{}^mC_{ds}A_{ds}A_{ds}T_{ds}{}^mC_{ds}T_{ds}G_{ds}T_{ds}{}^mC_{ks}T_{es}G_{ks}A_e$ | 39 | 2843 |
| 1198344 | N/A | N/A | 117327 | 117342 | ATATTGCAATCTGTCT | $A_{ks}T_{ks}A_{ks}T_{ds}T_{ds}G_{ds}{}^mC_{ds}A_{ds}A_{ds}T_{ds}{}^mC_{ds}T_{ds}G_{ks}{}^mC_{es}T_e$ | 55 | 2844 |
| 1198345 | N/A | N/A | 117328 | 117343 | AATATTGCAATCTGTC | $A_{ks}A_{ks}T_{ks}A_{ds}T_{ds}T_{ds}G_{ds}{}^mC_{ds}A_{ds}A_{ds}T_{ds}{}^mC_{ds}T_{ks}G_{es}T_{ks}{}^mC_e$ | 75 | 2845 |
| 1198346 | N/A | N/A | 117329 | 117344 | TAATATTGCAATCTGT | $T_{ks}A_{ks}A_{ks}T_{ds}A_{ds}T_{ds}T_{ds}G_{ds}{}^mC_{ds}A_{ds}A_{ds}T_{ds}{}^mC_{ks}T_{es}G_{ks}T_e$ | 40 | 2846 |
| 1198347 | N/A | N/A | 117330 | 117345 | GTAATATTGCAATCTG | $G_{ks}T_{ks}A_{ks}A_{ds}T_{ds}A_{ds}T_{ds}T_{ds}G_{ds}{}^mC_{ds}A_{ds}A_{ds}T_{ks}{}^mC_{es}T_{ks}G_e$ | 14 | 1404 |
| 1198348 | N/A | N/A | 117331 | 117346 | TGTAATATTGCAATCT | $T_{ks}G_{ks}T_{ks}A_{ds}A_{ds}T_{ds}A_{ds}T_{ds}T_{ds}G_{ds}{}^mC_{ds}A_{ds}A_{ks}T_{es}{}^mC_{ks}T_e$ | 40 | 2847 |

TABLE 49

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_{ks}$ | 30 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 13 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 10 | 2800 |
| 1095547 | 4443 | 4458 | 125468 | 125483 | ACTGAGGTATAACTGG | $A_{ks}{}^mC_{ks}T_{ks}G_{ds}A_{ds}G_{ds}G_{ds}T_{ds}A_{ds}T_{ds}A_{ds}A_{ds}{}^mC_{ks}T_{es}G_{ks}G_e$ | 42 | 392 |
| 1095565 | 4441 | 4456 | 125466 | 125481 | TGAGGTATAACTGGGC | $T_{ks}G_{ks}A_{ks}G_{ds}G_{ds}T_{ds}A_{ds}T_{ds}A_{ds}A_{ds}{}^mC_{ds}T_{ds}G_{ks}G_{es}G_{ks}{}^mC_e$ | 25 | 1580 |
| 1095566 | 4442 | 4457 | 125467 | 125482 | CTGAGGTATAACTGGG | ${}^mC_{ks}T_{ks}G_{ks}A_{ds}G_{ds}G_{ds}T_{ds}A_{ds}T_{ds}A_{ds}A_{ds}{}^mC_{ds}T_{ks}G_{es}G_{ks}G_e$ | 47 | 2801 |
| 1095567 | 4444 | 4459 | 125469 | 125484 | CACTGAGGTATAACTG | ${}^mC_{ks}A_{ks}{}^mC_{ks}T_{ds}G_{ds}A_{ds}G_{ds}G_{ds}T_{ds}A_{ds}T_{ds}A_{ds}A_{ks}{}^mC_{es}T_{ks}G_e$ | 92 | 2802 |
| 1198302 | 4436 | 4451 | 125461 | 125476 | TATAACTGGGCAAATT | $T_{ks}A_{ks}T_{ks}A_{ds}A_{ds}{}^mC_{ds}T_{ds}G_{ds}G_{ds}G_{ds}{}^mC_{ds}A_{ds}A_{ks}A_{es}T_{ks}T_e$ | 67 | 2815 |
| 1198303 | 4438 | 4453 | 125463 | 125478 | GGTATAACTGGGCAAA | $G_{ks}G_{ks}T_{ks}A_{ds}T_{ds}A_{ds}A_{ds}{}^mC_{ds}T_{ds}G_{ds}G_{ds}G_{ds}{}^mC_{ks}A_{es}A_{ks}A_e$ | 27 | 1427 |
| 1198304 | 4439 | 4454 | 125464 | 125479 | AGGTATAACTGGGCAA | $A_{ks}G_{ks}G_{ks}T_{ds}A_{ds}T_{ds}A_{ds}A_{ds}{}^mC_{ds}T_{ds}G_{ds}G_{ds}G_{ks}{}^mC_{es}A_{ks}A_e$ | 33 | 905 |
| 1198305 | 4440 | 4455 | 125465 | 125480 | GAGGTATAACTGGGCA | $G_{ks}A_{ks}G_{ks}G_{ds}T_{ds}A_{ds}T_{ds}A_{ds}A_{ds}{}^mC_{ds}T_{ds}G_{ds}G_{ks}{}^mC_{ks}A_e$ | 78 | 1503 |
| 1198306 | 4446 | 4461 | 125471 | 125486 | AACACTGAGGTATAAC | $A_{ks}A_{ks}{}^mC_{ks}A_{ds}{}^mC_{ds}T_{ds}G_{ds}A_{ds}G_{ds}G_{ds}T_{ds}A_{ds}T_{ks}A_{es}A_{ks}{}^mC_e$ | 64 | 2816 |
| 1198334 | N/A | N/A | 115903 | 115918 | ATATGGTTTTGTGTGT | $A_{ks}T_{ks}A_{ks}T_{ds}G_{ds}G_{ds}T_{ds}T_{ds}T_{ds}T_{ds}G_{ds}T_{ds}G_{ks}T_{es}G_{ks}T_e$ | 57 | 2839 |
| 1198335 | N/A | N/A | 115905 | 115920 | TTATATGGTTTTGTGT | $T_{ks}T_{ks}A_{ks}T_{ds}A_{ds}T_{ds}G_{ds}G_{ds}T_{ds}T_{ds}T_{ds}T_{ds}G_{ks}T_{es}G_{ks}T_e$ | 26 | 2840 |
| 1198336 | N/A | N/A | 115906 | 115921 | CTTATATGGTTTTGTG | ${}^mC_{ks}T_{ks}T_{ks}A_{ds}T_{ds}A_{ds}T_{ds}G_{ds}G_{ds}T_{ds}T_{ds}T_{ds}T_{ks}G_{es}T_{ks}G_e$ | 31 | 2788 |
| 1198337 | N/A | N/A | 115907 | 115922 | TCTTATATGGTTTTGT | $T_{ks}{}^mC_{ks}T_{ks}T_{ds}A_{ds}T_{ds}A_{ds}T_{ds}G_{ds}G_{ds}T_{ds}T_{ds}T_{ks}T_{es}G_{ks}T_e$ | 26 | 2841 |
| 1198338 | N/A | N/A | 115908 | 115923 | CTCTTATATGGTTTTG | ${}^mC_{ks}T_{ks}{}^mC_{ks}T_{ds}T_{ds}A_{ds}T_{ds}A_{ds}T_{ds}G_{ds}G_{ds}T_{ds}T_{ks}T_{es}T_{ks}G_e$ | 24 | 2842 |
| 1198339 | N/A | N/A | 115909 | 115924 | ACTCTTATATGGTTTT | $A_{ks}{}^mC_{ks}T_{ks}{}^mC_{ds}T_{ds}T_{ds}A_{ds}T_{ds}A_{ds}T_{ds}G_{ds}G_{ds}T_{ks}T_{es}T_{ks}T_e$ | 25 | 2859 |
| 1198340 | N/A | N/A | 115910 | 115925 | AACTCTTATATGGTTT | $A_{ks}A_{ks}{}^mC_{ks}T_{ds}{}^mC_{ds}T_{ds}T_{ds}A_{ds}T_{ds}A_{ds}T_{ds}G_{ds}G_{ks}T_{es}T_{ks}T_e$ | 123 | 2860 |
| 1198341 | N/A | N/A | 115911 | 115926 | CAACTCTTATATGGTT | ${}^mC_{ks}A_{ks}A_{ks}{}^mC_{ds}T_{ds}{}^mC_{ds}T_{ds}T_{ds}A_{ds}T_{ds}A_{ds}T_{ds}G_{ks}G_{es}T_{ks}T_e$ | 90 | 2861 |
| 1198342 | N/A | N/A | 115913 | 115928 | GACAACTCTTATATGG | $G_{ks}A_{ks}{}^mC_{ks}A_{ds}A_{ds}{}^mC_{ds}T_{ds}{}^mC_{ds}T_{ds}T_{ds}A_{ds}T_{ds}A_{ks}T_{es}G_{ks}G_e$ | 101 | 2862 |
| 1198349 | N/A | N/A | 117332 | 117347 | ATGTAATATTGCAATC | $A_{ks}T_{ks}G_{ks}T_{ds}A_{ds}A_{ds}T_{ds+}A_{ds}T_{ds}T_{ds}G_{ds}{}^mC_{ds}A_{ks}A_{es}T_{ks}{}^mC_e$ | 85 | 2848 |
| 1198350 | N/A | N/A | 117333 | 117348 | TATGTAATATTGCAAT | $T_{ks}A_{ks}T_{ks}G_{ds}T_{ds}A_{ds}A_{ds}T_{ds}A_{ds}T_{ds}T_{ds}G_{ds}{}^mC_{ks}A_{es}A_{ks}T_e$ | 83 | 2849 |
| 1198351 | N/A | N/A | 117335 | 117350 | TTTATGTAATATTGCA | $T_{ks}T_{ks}T_{ks}A_{ds}T_{ds}G_{ds}T_{ds}A_{ds}A_{ds}T_{ds}A_{ds}T_{ds}T_{ks}G_{es}{}^mC_{ks}A_e$ | 40 | 2850 |
| 1198352 | N/A | N/A | 117755 | 117770 | TGTATGTCAGAAGAGT | $T_{ks}G_{ks}T_{ks}A_{ds}T_{ds}G_{ds}T_{ds}{}^mC_{ds}A_{ds}G_{ds}A_{ds}A_{ds}G_{ks}A_{es}G_{ks}T_e$ | 7 | 2863 |
| 1198353 | N/A | N/A | 117757 | 117772 | AGTGTATGTCAGAAGA | $A_{ks}G_{ks}T_{ks}G_{ds}T_{ds}A_{ds}T_{ds}G_{ds}T_{ds}{}^mC_{ds}A_{ds}G_{ds}A_{ks}A_{es}G_{ks}A_e$ | 8 | 2864 |
| 1198354 | N/A | N/A | 117758 | 117773 | AAGTGTATGTCAGAAG | $A_{ks}A_{ks}G_{ks}T_{ds}G_{ds}T_{ds}A_{ds}T_{ds}G_{ds}T_{ds}{}^mC_{ds}A_{ds}G_{ks}A_{es}A_{ks}G_e$ | 6 | 2865 |
| 1198355 | N/A | N/A | 117759 | 117774 | AAAGTGTATGTCAGAA | $A_{ks}A_{ks}A_{ks}G_{ds}T_{ds}G_{ds}T_{ds}A_{ds}T_{ds}G_{ds}T_{ds}{}^mC_{ds}A_{ks}G_{es}A_{ks}A_e$ | 6 | 2866 |
| 1198356 | N/A | N/A | 117760 | 117775 | TAAAGTGTATGTCAGA | $T_{ks}A_{ks}A_{ks}A_{ds}G_{ds}T_{ds}G_{ds}T_{ds}A_{ds}T_{ds}G_{ds}T_{ds}{}^mC_{ks}A_{es}G_{ks}A_e$ | 5 | 2867 |
| 1198357 | N/A | N/A | 117761 | 117776 | TTAAAGTGTATGTCAG | $T_{ks}T_{ks}A_{ks}A_{ds}A_{ds}G_{ds}T_{ds}G_{ds}T_{ds}A_{ds}T_{ds}G_{ds}T_{ks}{}^mC_{es}A_{ks}G_e$ | 21 | 2868 |
| 1198358 | N/A | N/A | 117762 | 117777 | TTTAAAGTGTATGTCA | $T_{ks}T_{ks}T_{ks}A_{ds}A_{ds}A_{ds}G_{ds}T_{ds}G_{ds}T_{ds}A_{ds}T_{ds}G_{ks}T_{es}{}^mC_{ks}A_e$ | 15 | 2869 |
| 1198359 | N/A | N/A | 117763 | 117778 | CTTTAAAGTGTATGTC | ${}^mC_{ks}T_{ks}T_{ks}T_{ds}A_{ds}A_{ds}A_{ds}G_{ds}T_{ds}G_{ds}T_{ds}A_{ds}T_{ks}G_{es}T_{ks}{}^mC_e$ | 28 | 1634 |
| 1198360 | N/A | N/A | 117765 | 117780 | AACTTTAAAGTGTATG | $A_{ks}A_{ks}{}^mC_{ks}T_{ds}T_{ds}T_{ds}A_{ds}A_{ds}A_{ds}G_{ds}T_{ds}G_{ds}T_{ks}A_{es}T_{ks}G_e$ | 74 | 2870 |
| 1198361 | N/A | N/A | 119667 | 119682 | TAAGGTTTCCCAGATT | $T_{ks}A_{ks}A_{ks}G_{ds}G_{ds}T_{ds}T_{ds}T_{ds}{}^mC_{ds}{}^mC_{ds}{}^mC_{ds}A_{ds}G_{ks}A_{es}T_{ks}T_e$ | 39 | 2851 |
| 1198362 | N/A | N/A | 119669 | 119684 | AGTAAGGTTTCCCAGA | $A_{ks}G_{ks}T_{ks}A_{ds}A_{ds}G_{ds}G_{ds}T_{ds}T_{ds}T_{ds}{}^mC_{ds}{}^mC_{ds}{}^mC_{ks}A_{es}G_{ks}A_e$ | 24 | 2852 |
| 1198363 | N/A | N/A | 119670 | 119685 | AAGTAAGGTTTCCCAG | $A_{ks}A_{ks}G_{ks}T_{ds}A_{ds}A_{ds}G_{ds}G_{ds}T_{ds}T_{ds}T_{ds}{}^mC_{ds}{}^mC_{ks}{}^mC_{es}A_{ks}G_e$ | 55 | 2853 |

TABLE 49-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1198364 | N/A | N/A | 119671 | 119686 | TAAGTAAGGTTTCCCA | $T_{ks}A_{ks}A_{ks}G_{ds}T_{ds}A_{ds}A_{ds}G_{ds}G_{ds}T_{ds}T_{ds}T_{ds}{}^mC_{ks}{}^mC_{es}{}^mC_{ks}A_e$ | 29 | 2854 |
| 1198365 | N/A | N/A | 119672 | 119687 | CTAAGTAAGGTTTCCC | ${}^mC_{ks}T_{ks}A_{ks}A_{ds}G_{ds}T_{ds}A_{ds}A_{ds}G_{ds}G_{ds}T_{ds}T_{ds}T_{ks}{}^mC_{es}{}^mC_{ks}{}^mC_e$ | 13 | 1101 |
| 1198366 | N/A | N/A | 119673 | 119688 | ACTAAGTAAGGTTTCC | $A_{ks}{}^mC_{ks}T_{ks}A_{ds}A_{ds}G_{ds}T_{ds}A_{ds}A_{ds}G_{ds}G_{ds}T_{ds}T_{ks}T_{es}{}^mC_{ks}{}^mC_e$ | 45 | 2855 |
| 1198367 | N/A | N/A | 119674 | 119689 | GACTAAGTAAGGTTTC | $G_{ks}A_{ks}{}^mC_{ks}T_{ds}A_{ds}A_{ds}G_{ds}T_{ds}A_{ds}A_{ds}G_{ds}G_{ds}T_{ks}T_{es}T_{ks}{}^mC_e$ | 58 | 2856 |
| 1198368 | N/A | N/A | 119675 | 119690 | AGACTAAGTAAGGTTT | $A_{ks}G_{ks}A_{ks}{}^mC_{ds}T_{ds}A_{ds}A_{ds}G_{ds}T_{ds}A_{ds}A_{ds}G_{ks}T_{es}T_{ks}T_e$ | 79 | 2857 |
| 1198369 | N/A | N/A | 119677 | 119692 | TTAGACTAAGTAAGGT | $T_{ks}T_{ks}A_{ks}G_{ds}A_{ds}{}^mC_{ds}T_{ds}A_{ds}A_{ds}G_{ds}T_{ds}A_{ds}A_{ks}G_{es}G_{ks}T_e$ | 51 | 2858 |
| 1198542 | 2524 | 2539 | 123549 | 123564 | TGTCTCATGCCTTATA | $T_{ks}G_{ks}T_{ks}{}^mC_{ds}T_{ds}{}^mC_{ds}A_{ds}T_{ds}G_{ds}{}^mC_{ds}{}^mC_{ds}T_{ds}T_{ks}A_{ks}T_{ks}A_e$ | 23 | 2803 |
| 1198543 | 2526 | 2541 | 123551 | 123566 | ATTGTCTCATGCCTTA | $A_{ks}T_{ks}T_{ks}G_{ds}T_{ds}{}^mC_{ds}T_{ds}{}^mC_{ds}A_{ds}T_{ds}G_{ds}{}^mC_{ds}{}^mC_{ks}T_{ks}T_{ks}A_e$ | 15 | 2804 |
| 1198544 | 2527 | 2542 | 123552 | 123567 | AATTGTCTCATGCCTT | $A_{ks}A_{ks}T_{ks}T_{ds}G_{ds}T_{ds}{}^mC_{ds}T_{ds}{}^mC_{ds}A_{ds}T_{ds}G_{ds}{}^mC_{ks}{}^mC_{ks}T_{ks}T_e$ | 21 | 2805 |
| 1198545 | 2528 | 2543 | 123553 | 123568 | AAATTGTCTCATGCCT | $A_{ks}A_{ks}A_{ks}T_{ds}T_{ds}G_{ds}T_{ds}{}^mC_{ds}T_{ds}{}^mC_{ds}A_{ds}T_{ds}G_{ks}{}^mC_{ks}{}^mC_{ks}T_e$ | 32 | 443 |
| 1198546 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ks}G_{ks}{}^mC_{ks}{}^mC_e$ | 11 | 2800 |
| 1198547 | 2530 | 2545 | 123555 | 123570 | GGAAATTGTCTCATGC | $G_{ks}G_{ks}A_{ks}A_{ds}A_{ds}T_{ds}T_{ds}G_{ds}T_{ds}{}^mC_{ds}T_{ds}{}^mC_{ds}A_{ks}T_{ks}G_{ks}{}^mC_e$ | 27 | 2806 |
| 1198548 | 2531 | 2546 | 123556 | 123571 | TGGAAATTGTCTCATG | $T_{ks}G_{ks}G_{ks}A_{ds}A_{ds}A_{ds}T_{ds}T_{ds}G_{ds}T_{ds}{}^mC_{ds}T_{ds}{}^mC_{ks}A_{ks}T_{ks}G_e$ | 26 | 2807 |
| 1198549 | 2532 | 2547 | 123557 | 123572 | ATGGAAATTGTCTCAT | $A_{ks}T_{ks}G_{ks}G_{ds}A_{ds}A_{ds}A_{ds}T_{ds}T_{ds}G_{ds}T_{ds}{}^mC_{ds}T_{ks}{}^mC_{ks}A_{ks}T_e$ | 84 | 2808 |
| 1198550 | 2534 | 2549 | 123559 | 123574 | ATATGGAAATTGTCTC | $A_{ks}T_{ks}A_{ks}T_{as}G_{ds}G_{ds}A_{ds}A_{ds}A_{ds}T_{ds}T_{ds}G_{ds}T_{ks}{}^mC_{ks}T_{ks}{}^mC_e$ | 17 | 656 |
| 1198551 | 2560 | 2575 | 123585 | 123600 | AGTATGTGGCAATAAT | $A_{ks}G_{ks}T_{ks}A_{ds}T_{ds}G_{ds}T_{ds}G_{ds}G_{ds}{}^mC_{ds}A_{ds}A_{ds}T_{ks}A_{ks}A_{ks}T_e$ | 34 | 2809 |
| 1198552 | 2562 | 2577 | 123587 | 123602 | AGAGTATGTGGCAATA | $A_{ks}G_{ks}A_{ks}G_{ds}T_{ds}A_{ds}T_{ds}G_{ds}T_{ds}G_{ds}G_{ds}{}^mC_{ds}A_{ks}T_{ks}A_e$ | 17 | 2810 |
| 1198553 | 2563 | 2578 | 123588 | 123603 | TAGAGTATGTGGCAAT | $T_{ks}A_{ks}G_{ks}A_{ds}G_{ds}T_{ds}A_{ds}T_{ds}G_{ds}T_{ds}G_{ds}G_{ds}{}^mC_{ks}A_{ks}A_{ks}T_e$ | 13 | 2811 |
| 1198554 | 2564 | 2579 | 123589 | 123604 | TTAGAGTATGTGGCAA | $T_{ks}T_{ks}A_{ks}G_{ds}A_{ds}G_{ds}T_{ds}A_{ds}T_{ds}G_{ds}T_{ds}G_{ds}G_{ks}{}^mC_{ks}A_{ks}A_e$ | 16 | 963 |
| 1198555 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ks}G_{ks}{}^mC_{ks}A_e$ | 11 | 810 |
| 1198556 | 2566 | 2581 | 123591 | 123606 | TATTAGAGTATGTGGC | $T_{ks}A_{ks}T_{ks}T_{ds}A_{ds}G_{ds}A_{ds}G_{ds}T_{ds}A_{ds}T_{ds}G_{ds}T_{ks}G_{ks}G_{ks}{}^mC_e$ | 25 | 2812 |
| 1198557 | 2567 | 2582 | 123592 | 123607 | ATATTAGAGTATGTGG | $A_{ks}T_{ks}A_{ks}T_{ds}T_{ds}A_{ds}G_{ds}A_{ds}G_{ds}T_{ds}A_{ds}T_{ds}G_{ks}T_{ks}G_{ks}G_e$ | 16 | 2813 |
| 1198558 | 2568 | 2583 | 123593 | 123608 | TATATTAGAGTATGTG | $T_{ks}A_{ks}T_{ks}A_{ds}T_{ds}T_{ds}A_{ds}G_{ds}A_{ds}G_{ds}T_{ds}A_{ds}T_{ks}G_{ks}T_{ks}G_e$ | 46 | 2814 |
| 1198559 | 2570 | 2585 | 123595 | 123610 | TCTATATTAGAGTATG | $T_{ks}{}^mC_{ks}T_{ks}A_{ds}T_{ds}A_{ds}T_{ds}T_{ds}A_{ds}G_{ds}A_{ds}G_{ds}T_{ks}A_{ks}T_{ks}G_e$ | 55 | 887 |
| 1198565 | 4595 | 4610 | 125620 | 125635 | TTACATTAGGAACAAG | $T_{ks}T_{ks}A_{ks}{}^mC_{ds}A_{ds}T_{ds}T_{ds}A_{ds}G_{ds}G_{ds}A_{ds}A_{ds}{}^mC_{ks}A_{ks}A_{ks}G_e$ | 53 | 2817 |
| 1198566 | 4597 | 4612 | 125622 | 125637 | TTTTACATTAGGAACA | $T_{ks}T_{ks}T_{ks}T_{ds}A_{ds}{}^mC_{ds}A_{ds}T_{ds}T_{ds}A_{ds}G_{ds}G_{ds}A_{ks}A_{ks}{}^mC_{ks}A_e$ | 83 | 2818 |
| 1198567 | 4598 | 4613 | 125623 | 125638 | CTTTTACATTAGGAAC | ${}^mC_{ks}T_{ks}T_{ks}T_{ds}T_{ds}A_{ds}{}^mC_{ds}A_{ds}T_{ds}T_{ds}A_{ds}G_{ds}G_{ks}A_{ks}A_{ks}{}^mC_e$ | 54 | 1124 |
| 1198568 | 4599 | 4614 | 125624 | 125639 | ACTTTTACATTAGGAA | $A_{ks}{}^mC_{ks}T_{ks}T_{ds}T_{ds}T_{ds}A_{ds}{}^mC_{ds}A_{ds}T_{ds}T_{ds}A_{ds}G_{ks}G_{ks}A_{ks}A_e$ | 31 | 2819 |
| 1198569 | 4600 | 4615 | 125625 | 125640 | CACTTTTACATTAGGA | ${}^mC_{ks}A_{ks}{}^mC_{ks}T_{ds}T_{ds}T_{ds}T_{ds}A_{ds}{}^mC_{ds}A_{ds}T_{ds}T_{ds}A_{ks}G_{ks}G_{ks}A_e$ | 14 | 1200 |
| 1198570 | 4601 | 4616 | 125626 | 125641 | GCACTTTTACATTAGG | $G_{ks}{}^mC_{ks}A_{ks}{}^mC_{ds}T_{ds}T_{ds}T_{ds}T_{ds}A_{ds}{}^mC_{ds}A_{ds}T_{ds}T_{ks}A_{ks}G_{ks}G_e$ | 15 | 1276 |
| 1198571 | 4602 | 4617 | 125627 | 125642 | AGCACTTTTACATTAG | $A_{ks}G_{ks}{}^mC_{ks}A_{ds}{}^mC_{ds}T_{ds}T_{ds}T_{ds}T_{ds}A_{ds}{}^mC_{ds}A_{ds}T_{ks}T_{ks}A_{ks}G_e$ | 32 | 2820 |
| 1198572 | 4603 | 4618 | 125628 | 125643 | AAGCACTTTTACATTA | $A_{ks}A_{ks}G_{ks}{}^mC_{ds}A_{ds}{}^mC_{ds}T_{ds}T_{ds}T_{ds}T_{ds}A_{ds}{}^mC_{ds}A_{ks}T_{ks}T_{ks}A_e$ | 53 | 2821 |
| 1198573 | 4605 | 4620 | 125630 | 125645 | TTAAGCACTTTTACAT | $T_{ks}T_{ks}A_{ks}A_{ds}G_{ds}{}^mC_{ds}A_{ds}{}^mC_{ds}T_{ds}T_{ds}T_{ds}T_{ds}A_{ks}{}^mC_{ks}A_{ks}T_e$ | 76 | 2822 |
| 1198574 | 4795 | 4810 | 125820 | 125835 | GGAAGATCTGAAACTC | $G_{ks}G_{ks}A_{ks}A_{ds}G_{ds}A_{ds}T_{ds}{}^mC_{ds}T_{ds}G_{ds}A_{ds}A_{ds}A_{ks}{}^mC_{ks}T_{ks}{}^mC_e$ | 37 | 2823 |
| 1198575 | 4797 | 4812 | 125822 | 125837 | TTGGAAGATCTGAAAC | $T_{ks}T_{ks}G_{ks}G_{ds}A_{ds}A_{ds}G_{ds}A_{ds}T_{ds}{}^mC_{ds}T_{ds}G_{ds}A_{ks}A_{ks}A_{ks}{}^mC_e$ | 94 | 2824 |
| 1198576 | 4798 | 4813 | 125823 | 125838 | TTTGGAAGATCTGAAA | $T_{ks}T_{ks}T_{ks}G_{ds}G_{ds}A_{ds}A_{ds}G_{ds}A_{ds}T_{ds}{}^mC_{ds}T_{ds}G_{ks}A_{ks}A_{ks}A_e$ | 92 | 2825 |

TABLE 49-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1198577 | 4799 | 4814 | 125824 | 125839 | CTTTGGAAGATCTGAA | $^mC_{ks}T_{ks}T_{ks}T_{ds}G_{ds}G_{ds}A_{ds}A_{ds}G_{ds}A_{ds}$ $T_{ds}{}^mC_{ds}T_{ks}G_{ks}A_{ks}A_e$ | 40 | 2826 |
| 1198578 | 4800 | 4815 | 125825 | 125840 | GCTTTGGAAGATCTGA | $^mC_{ks}T_{ks}T_{ds}G_{ds}G_{ds}A_{ds}A_{ds}G_{ds}A_{ds}$ $A_{ds}T_{ds}{}^mC_{ks}T_{ks}G_{ks}A_e$ | 18 | 2044 |
| 1198579 | 4801 | 4816 | 125826 | 125841 | TGCTTTGGAAGATCTG | $T_{ks}G_{ks}{}^mC_{ks}T_{ds}T_{ds}T_{ds}G_{ds}G_{ds}A_{ds}A_{ds}$ $G_{ds}A_{ds}T_{ks}{}^mC_{ks}T_{ks}G_e$ | 34 | 2121 |
| 1198580 | 4802 | 4817 | 125827 | 125842 | GTGCTTTGGAAGATCT | $G_{ks}T_{ks}G_{ks}{}^mC_{ds}T_{ds}T_{ds}T_{ds}G_{ds}G_{ds}A_{ds}$ $A_{ds}G_{ds}A_{ks}T_{ks}{}^mC_{ks}T_e$ | 43 | 2827 |
| 1198581 | 4803 | 4818 | 125828 | 125843 | AGTGCTTTGGAAGATC | $A_{ks}G_{ks}T_{ks}G_{ds}{}^mC_{ds}T_{ds}T_{ds}T_{ds}G_{ds}G_{ds}$ $A_{ds}A_{ds}G_{ks}A_{ks}T_{ks}{}^mC_e$ | 42 | 2828 |
| 1198582 | 4805 | 4820 | 125830 | 125845 | ATAGTGCTTTGGAAGA | $A_{ks}T_{ks}A_{ks}G_{ds}T_{ds}G_{ds}{}^mC_{ds}T_{ds}T_{ds}T_{ds}$ $G_{ds}G_{ds}A_{ks}A_{ks}G_{ks}A_e$ | 63 | 2829 |
| 1198583 | N/A | N/A | 94729 | 94744 | AGGATGCATGGTTTTT | $A_{ks}G_{ks}G_{ks}A_{ds}T_{ds}G_{ds}{}^mC_{ds}A_{ds}T_{ds}G_{ds}$ $G_{ds}T_{ds}T_{ks}T_{ks}T_{ks}T_e$ | 27 | 2830 |
| 1198584 | N/A | N/A | 94731 | 94746 | TTAGGATGCATGGTTT | $T_{ks}T_{ks}A_{ks}G_{ds}G_{ds}A_{ds}T_{ds}G_{ds}{}^mC_{ds}$ $T_{ds}G_{ds}G_{ks}T_{ks}T_{ks}T_e$ | 37 | 2831 |

TABLE 50

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}$ $T_{ds}A_{ds}G_{ds}{}^mC_{ds}T_{ks}T_{ks}A_k$ | 31 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}$ $G_{ds}T_{ds}G_{ds}G_{ks}{}^mC_{ks}A_k$ | 12 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}$ $^mC_{ds}A_{ds}T_{ds}G_{ks}{}^mC_{ks}{}^mC_k$ | 16 | 2800 |
| 1095435 | 4443 | 4458 | 125468 | 125483 | ACTGAGGTATAACTGG | $A_{ks}{}^mC_{ks}T_{ks}G_{ds}A_{ds}G_{ds}G_{ds}T_{ds}A_{ds}T_{ds}$ $A_{ds}A_{ds}{}^mC_{ks}T_{ks}G_{ks}G_e$ | 39 | 392 |
| 1095453 | 4441 | 4456 | 125466 | 125481 | TGAGGTATAACTGGGC | $T_{ks}G_{ks}A_{ks}G_{ds}G_{ds}T_{ds}A_{ds}T_{ds}A_{ds}A_{ds}{}^m$ $C_{ds}T_{ds}G_{ks}G_{ks}G_{ks}{}^mC_e$ | 32 | 1580 |
| 1095454 | 4442 | 4457 | 125467 | 125482 | CTGAGGTATAACTGGG | $^mC_{ks}T_{ks}G_{ks}A_{ds}G_{ds}G_{ds}T_{ds}A_{ds}T_{ds}A_{ds}$ $A_{ds}{}^mC_{ds}T_{ks}G_{ks}G_{ks}G_e$ | 47 | 2801 |
| 1197228 | 2527 | 2542 | 123552 | 123567 | AATTGTCTCATGCCTT | $A_{ks}A_{ks}T_{ks}T_{ds}G_{ys}T_{ds}{}^mC_{ds}T_{ds}{}^mC_{ds}$ $A_{ds}T_{ds}G_{ds}{}^mC_{ds}{}^mC_{ks}T_{ks}T_k$ | 25 | 2805 |
| 1197229 | 2530 | 2545 | 123555 | 123570 | GGAAATTGTCTCATGC | $G_{ks}G_{ks}A_{ks}A_{ds}A_{ys}T_{ds}T_{ds}G_{ds}T_{ds}{}^mC_{ds}$ $T_{ds}{}^mC_{ds}A_{ds}T_{ks}G_{ks}{}^mC_k$ | 21 | 2806 |
| 1197230 | 2531 | 2546 | 123556 | 123571 | TGGAAATTGTCTCATG | $T_{ks}G_{ks}G_{ks}A_{ds}A_{ys}A_{ds}T_{ds}T_{ds}G_{ds}T_{ds}{}^m$ $C_{ds}T_{ds}{}^mC_{ds}A_{ks}T_{ks}G_k$ | 29 | 2807 |
| 1197231 | 2532 | 2547 | 123557 | 123572 | ATGGAAATTGTCTCAT | $A_{ks}T_{ks}G_{ks}G_{ds}A_{ys}A_{ds}A_{ds}T_{ds}T_{ds}G_{ds}$ $T_{ds}{}^mC_{ds}T_{ds}{}^mC_{ks}A_{ks}T_k$ | 50 | 2808 |
| 1197232 | 2534 | 2549 | 123559 | 123574 | ATATGGAAATTGTCTC | $A_{ks}T_{ks}A_{ks}T_{ds}G_{ys}G_{ds}A_{ds}A_{ds}A_{ds}T_{ds}$ $T_{ds}G_{ds}T_{ds}{}^mC_{ks}T_{ks}{}^mC_k$ | 55 | 656 |
| 1197233 | 2563 | 2578 | 123588 | 123603 | TAGAGTATGTGGCAAT | $T_{ks}A_{ks}G_{ks}A_{ds}G_{ys}T_{ds}A_{ds}T_{ds}G_{ds}T_{ds}$ $G_{ds}G_{ds}{}^mC_{ds}A_{ks}A_{ks}T_k$ | 36 | 2811 |
| 1197234 | 2564 | 2579 | 123589 | 123604 | TTAGAGTATGTGGCAA | $T_{ks}T_{ks}A_{ks}G_{ds}A_{ys}G_{ds}T_{ds}A_{ds}T_{ds}G_{ds}$ $T_{ds}G_{ds}G_{ds}{}^mC_{ks}A_{ks}A_k$ | 24 | 963 |
| 1197235 | 2565 | 2580 | 123590 | 123605 | ATTAGAGTATGTGGCA | $A_{ks}T_{ks}T_{ks}A_{ds}G_{ys}A_{ds}G_{ds}T_{ds}A_{ds}T_{ds}$ $G_{ds}T_{ds}G_{ds}G_{ks}{}^mC_{ks}A_k$ | 16 | 810 |
| 1197236 | 2566 | 2581 | 123591 | 123606 | TATTAGAGTATGTGGC | $T_{ks}A_{ks}T_{ks}T_{ds}A_{ys}G_{ds}A_{ds}G_{ds}T_{ds}A_{ds}T_{ds}$ $T_{ds}G_{ds}T_{ds}G_{ks}G_{ks}{}^mC_k$ | 17 | 2812 |
| 1197244 | 4595 | 4610 | 125620 | 125635 | TTACATTAGGAACAAG | $T_{ks}T_{ks}A_{ks}{}^mC_{ds}A_{ys}T_{ds}T_{ds}A_{ds}G_{ds}G_{ds}$ $A_{ds}A_{ds}{}^mC_{ds}A_{ks}A_{ks}G_k$ | 60 | 2817 |
| 1197245 | 4597 | 4612 | 125622 | 125637 | TTTTACATTAGGAACA | $T_{ks}T_{ks}T_{ks}T_{ds}A_{ys}{}^mC_{ds}A_{ds}T_{ds}T_{ds}A_{ds}$ $G_{ds}G_{ds}A_{ds}A_{ks}{}^mC_{ks}A_k$ | 60 | 2818 |
| 1197246 | 4602 | 4617 | 125627 | 125642 | AGCACTTTTACATTAG | $A_{ks}G_{ks}{}^mC_{ks}A_{ds}C_{ys}T_{ds}T_{ds}T_{ds}T_{ds}A_{ds}{}^m$ $C_{ds}A_{ds}T_{ds}T_{ks}A_{ks}G_k$ | 33 | 2820 |
| 1197247 | 4603 | 4618 | 125628 | 125643 | AAGCACTTTTACATTA | $A_{ks}A_{ks}G_{ks}{}^mC_{ds}A_{ys}{}^mC_{ds}T_{ds}T_{ds}T_{ds}$ $T_{ds}A_{ds}{}^mC_{ds}A_{ks}T_{ks}T_{ks}A_k$ | 47 | 2821 |
| 1197280 | 2524 | 2539 | 123549 | 123564 | TGTCUCATGCCTTATA | $T_{ks}G_{ks}T_{ks}{}^mC_{ds}U_{ys}{}^mC_{ds}A_{ds}T_{ds}G_{ds}{}^m$ $C_{ds}{}^mC_{ds}T_{ds}T_{ds}A_{ks}T_{ks}A_k$ | 53 | 2871 |
| 1197281 | 2526 | 2541 | 123551 | 123566 | ATTGUCTCATGCCTTA | $A_{ks}T_{ks}T_{ks}G_{ds}U_{ys}{}^mC_{ds}T_{ds}{}^mC_{ds}A_{ds}$ $T_{ds}G_{ds}{}^mC_{ds}{}^mC_{ds}T_{ks}T_{ks}A_k$ | 42 | 2872 |

TABLE 50-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1197282 | 2528 | 2543 | 123553 | 123568 | AAATUGTCTCATGCCT | $A_{ks}A_{ks}A_{ks}T_{ds}U_{ys}G_{ds}{}^mC_{ds}T_{ds}{}^mC_{ds}A_{ds}T_{ds}G_{ds}{}^mC_{ks}{}^mC_{ks}T_k$ | 40 | 2873 |
| 1197283 | 2529 | 2544 | 123554 | 123569 | GAAAUTGTCTCATGCC | $G_{ks}A_{ks}A_{ks}A_{ds}U_{ys}T_{ds}G_{ds}T_{ds}{}^mC_{ds}T_{ds}{}^mC_{ds}A_{ds}T_{ds}G_{ks}{}^mC_{ks}{}^mC_k$ | 29 | 2874 |
| 1197284 | 2560 | 2575 | 123585 | 123600 | AGTAUGTGGCAATAAT | $A_{ks}G_{ks}T_{ks}A_{ds}U_{ys}G_{ds}T_{ds}G_{ds}G_{ds}{}^mC_{ds}A_{ds}A_{ds}T_{ds}A_{ks}A_{ks}T_k$ | 35 | 2875 |
| 1197285 | 2562 | 2577 | 123587 | 123602 | AGAGUATGTGGCAATA | $A_{ks}G_{ks}A_{ks}G_{ds}U_{ys}A_{ds}T_{ds}G_{ds}T_{ds}G_{ds}G_{ds}{}^mC_{ds}A_{ds}A_{ks}T_{ks}A_k$ | 28 | 2876 |
| 1197286 | 2567 | 2582 | 123592 | 123607 | ATATUAGAGTATGTGG | $A_{ks}T_{ks}A_{ks}T_{ds}U_{ys}A_{ds}G_{ds}A_{ds}G_{ds}T_{ds}A_{ds}T_{ds}G_{ds}T_{ks}G_{ks}G_k$ | 43 | 2877 |
| 1197287 | 2568 | 2583 | 123593 | 123608 | TATAUTAGAGTATGTG | $T_{ks}A_{ks}T_{ks}A_{ds}U_{ys}T_{ds}A_{ds}G_{ds}A_{ds}G_{ds}T_{ds}A_{ds}T_{ds}G_{ks}T_{ks}G_k$ | 108 | 2878 |
| 1197288 | 2570 | 2585 | 123595 | 123610 | TCTAUATTAGAGTATG | $T_{ks}{}^mC_{ks}T_{ks}A_{ds}U_{ys}A_{ds}T_{ds}T_{ds}A_{ds}G_{ds}A_{ds}G_{ds}T_{ds}A_{ks}T_{ks}G_k$ | 94 | 2879 |
| 1197291 | 4598 | 4613 | 125623 | 125638 | CTTTUACATTAGGAAC | ${}^mC_{ks}T_{ks}T_{ks}T_{ds}U_{ys}A_{ds}{}^mC_{ds}A_{ds}T_{ds}T_{ds}A_{ds}G_{ds}G_{ds}A_{ks}A_{ks}{}^mC_k$ | 83 | 2880 |
| 1197292 | 4599 | 4614 | 125624 | 125639 | ACTTUTACATTAGGAA | $A_{ks}{}^mC_{ks}T_{ks}T_{ds}U_{ys}T_{ds}A_{ds}{}^mC_{ds}A_{ds}T_{ds}T_{ds}A_{ds}G_{ds}G_{ks}A_{ks}A_k$ | 84 | 2881 |
| 1197293 | 4600 | 4615 | 125625 | 125640 | CACTUTTACATTAGGA | ${}^mC_{ks}A_{ks}{}^mC_{ks}T_{ds}U_{ys}T_{ds}T_{ds}A_{ds}{}^mC_{ds}A_{ds}T_{ds}T_{ds}A_{ds}G_{ks}G_{ks}A_k$ | 94 | 2882 |
| 1197294 | 4601 | 4616 | 125626 | 125641 | GCACUTTTACATTAGG | $G_{ks}{}^mC_{ks}A_{ks}{}^mC_{ds}U_{ys}T_{ds}T_{ds}T_{ds}A_{ds}{}^mC_{ds}A_{ds}T_{ds}T_{ds}A_{ks}G_{ks}G_k$ | 25 | 2883 |
| 1198560 | 4436 | 4451 | 125461 | 125476 | TATAACTGGGCAAATT | $T_{ks}A_{ks}T_{ks}A_{ds}A_{ds}{}^mC_{ds}T_{ds}G_{ds}G_{ds}G_{ds}{}^mC_{ds}A_{ds}A_{ks}A_{ks}T_{ks}T_e$ | 53 | 2815 |
| 1198561 | 4438 | 4453 | 125463 | 125478 | GGTATAACTGGGCAAA | $G_{ks}G_{ks}T_{ks}A_{ds}T_{ds}A_{ds}A_{ds}{}^mC_{ds}T_{ds}G_{ds}G_{ds}G_{ds}{}^mC_{ks}A_{ks}A_{ks}A_e$ | 29 | 1427 |
| 1198562 | 4439 | 4454 | 125464 | 125479 | AGGTATAACTGGGCAA | $A_{ks}G_{ks}G_{ks}T_{ds}A_{ds}T_{ds}A_{ds}A_{ds}{}^mC_{ds}T_{ds}G_{ds}G_{ds}G_{ks}{}^mC_{ks}A_{ks}A_e$ | 30 | 905 |
| 1198563 | 4440 | 4455 | 125465 | 125480 | GAGGTATAACTGGGCA | $G_{ks}A_{ks}G_{ks}G_{ds}T_{ds}A_{ds}T_{ds}A_{ds}A_{ds}{}^mC_{ds}T_{ds}G_{ds}G_{ks}G_{ks}{}^mC_{ks}A_e$ | 53 | 1503 |
| 1198564 | 4446 | 4461 | 125471 | 125486 | AACACTGAGGTATAAC | $A_{ks}A_{ks}{}^mC_{ds}A_{ds}{}^mC_{ds}T_{ds}G_{ds}A_{ds}G_{ds}G_{ds}T_{ds}A_{ds}T_{ks}A_{ks}A_{ks}{}^mC_e$ | 44 | 2816 |
| 1198585 | N/A | N/A | 94732 | 94747 | TTTAGGATGCATGGTT | $T_{ks}T_{ks}T_{ks}A_{ds}G_{ds}G_{ds}A_{ds}T_{ds}G_{ds}{}^mC_{ds}A_{ds}T_{ds}G_{ks}G_{ks}T_{ks}T_e$ | 22 | 2832 |
| 1198586 | N/A | N/A | 94733 | 94748 | ATTTAGGATGCATGGT | $A_{ks}T_{ks}T_{ks}T_{ds}A_{ds}G_{ds}G_{ds}A_{ds}T_{ds}G_{ds}{}^mC_{ds}A_{ds}T_{ks}G_{ks}G_{ks}T_e$ | 96 | 2833 |
| 1198587 | N/A | N/A | 94734 | 94749 | GATTTAGGATGCATGG | $G_{ks}A_{ks}T_{ks}T_{ds}T_{ds}A_{ds}G_{ds}G_{ds}A_{ds}T_{ds}G_{ds}{}^mC_{ds}A_{ks}T_{ks}G_{ks}G_e$ | 41 | 2834 |
| 1198588 | N/A | N/A | 94735 | 94750 | AGATTTAGGATGCATG | $A_{ks}G_{ks}A_{ks}T_{ds}T_{ds}T_{ds}A_{ds}G_{ds}G_{ds}A_{ds}T_{ds}G_{ds}{}^mC_{ks}A_{ks}T_{ks}G_e$ | 32 | 2835 |
| 1198589 | N/A | N/A | 94736 | 94751 | CAGATTTAGGATGCAT | ${}^mC_{ks}A_{ks}G_{ks}A_{ds}T_{ds}T_{ds}T_{ds}A_{ds}G_{ds}G_{ds}A_{ds}T_{ds}G_{ks}{}^mC_{ks}A_{ks}T_e$ | 24 | 2836 |
| 1198590 | N/A | N/A | 94737 | 94752 | TCAGATTTAGGATGCA | $T_{ks}{}^mC_{ks}A_{ks}G_{ds}A_{ds}T_{ds}T_{ds}T_{ds}A_{ds}G_{ds}G_{ds}A_{ds}T_{ks}G_{ks}{}^mC_{ks}A_e$ | 46 | 2837 |
| 1198591 | N/A | N/A | 94739 | 94754 | ATTCAGATTTAGGATG | $A_{ks}T_{ks}T_{ks}{}^mC_{ds}A_{ds}G_{ds}A_{ds}T_{ds}T_{ds}T_{ds}A_{ds}G_{ds}G_{ks}A_{ks}T_{ks}G_e$ | 106 | 2838 |
| 1198592 | N/A | N/A | 115903 | 115918 | ATATGGTTTTGTGTGT | $A_{ks}T_{ks}A_{ks}T_{ds}G_{ds}G_{ds}T_{ds}T_{ds}T_{ds}T_{ds}G_{ds}T_{ds}G_{ks}T_{ks}G_{ks}T_e$ | 50 | 2839 |
| 1198593 | N/A | N/A | 115905 | 115920 | TTATATGGTTTTGTGT | $T_{ks}T_{ks}A_{ks}T_{ds}A_{ds}T_{ds}G_{ds}G_{ds}T_{ds}T_{ds}T_{ds}T_{ds}G_{ks}T_{ks}G_{ks}T_e$ | 45 | 2840 |
| 1198594 | N/A | N/A | 115906 | 115921 | CTTATATGGTTTTGTG | ${}^mC_{ks}T_{ks}T_{ks}A_{ds}T_{ds}A_{ds}T_{ds}G_{ds}G_{ds}T_{ds}T_{ds}T_{ds}T_{ks}G_{ks}T_{ks}G_e$ | 23 | 2788 |
| 1198595 | N/A | N/A | 115907 | 115922 | TCTTATATGGTTTTGT | $T_{ks}{}^mC_{ks}T_{ks}T_{ds}A_{ds}T_{ds}A_{ds}T_{ds}G_{ds}G_{ds}T_{ds}T_{ds}T_{ks}T_{ks}G_{ks}T_e$ | 27 | 2841 |
| 1198596 | N/A | N/A | 115908 | 115923 | CTCTTATATGGTTTTG | ${}^mC_{ks}T_{ks}{}^mC_{ks}T_{ds}T_{ds}A_{ds}T_{ds}A_{ds}T_{ds}G_{ds}G_{ds}T_{ds}T_{ks}T_{ks}T_{ks}G_e$ | 16 | 2842 |
| 1198597 | N/A | N/A | 115909 | 115924 | ACTCTTATATGGTTTT | $A_{ks}{}^mC_{ks}T_{ks}{}^mC_{ds}T_{ds}T_{ds}A_{ds}T_{ds}A_{ds}T_{ds}G_{ds}G_{ds}T_{ks}T_{ks}T_{ks}T_e$ | 27 | 2859 |
| 1198598 | N/A | N/A | 115910 | 115925 | AACTCTTATATGGTTT | $A_{ks}A_{ks}{}^mC_{ks}T_{ds}{}^mC_{ds}T_{ds}T_{ds}A_{ds}T_{ds}A_{ds}T_{ds}G_{ds}G_{ks}T_{ks}T_{ks}T_e$ | 76 | 2860 |
| 1198599 | N/A | N/A | 115911 | 115926 | CAACTCTTATATGGTT | ${}^mC_{ks}A_{ks}A_{ks}{}^mC_{ds}T_{ds}{}^mC_{ds}T_{ds}T_{ds}A_{ds}T_{ds}A_{ds}T_{ds}G_{ks}G_{ks}T_{ks}T_e$ | 90 | 2861 |
| 1198600 | N/A | N/A | 115913 | 115928 | GACAACTCTTATATGG | $G_{ks}A_{ks}{}^mC_{ks}A_{ds}A_{ds}{}^mC_{ds}T_{ds}{}^mC_{ds}T_{ds}T_{ds}A_{ds}T_{ds}A_{ks}T_{ks}G_{ks}G_e$ | 72 | 2862 |
| 1198601 | N/A | N/A | 117325 | 117340 | ATTGCAATCTGTCTGA | $A_{ks}T_{ks}T_{ks}G_{ds}{}^mC_{ds}A_{ds}A_{ds}T_{ds}{}^mC_{ds}T_{ds}G_{ds}T_{ds}{}^mC_{ks}T_{ks}G_{ks}A_e$ | 50 | 2843 |
| 1198602 | N/A | N/A | 117327 | 117342 | ATATTGCAATCTGTCT | $A_{ks}T_{ks}A_{ks}T_{ds}T_{ds}G_{ds}{}^mC_{ds}A_{ds}A_{ds}T_{ds}{}^mC_{ds}T_{ds}G_{ks}T_{ks}{}^mC_{ks}T_e$ | 29 | 2844 |
| 1198603 | N/A | N/A | 117328 | 117343 | AATATTGCAATCTGTC | $A_{ks}A_{ks}T_{ks}A_{ds}T_{ds}T_{ds}G_{ds}{}^mC_{ds}A_{ds}A_{ds}T_{ds}{}^mC_{ds}T_{ks}G_{ks}T_{ks}{}^mC_e$ | 51 | 2845 |
| 1198604 | N/A | N/A | 117329 | 117344 | TAATATTGCAATCTGT | $T_{ks}A_{ks}A_{ks}T_{ds}A_{ds}T_{ds}T_{ds}G_{ds}{}^mC_{ds}A_{ds}A_{ds}T_{ds}{}^mC_{ks}T_{ks}G_{ks}T_e$ | 48 | 2846 |

TABLE 50-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1198605 | N/A | N/A | 117330 | 117345 | GTAATATTGCAATCTG | $G_{ks}T_{ks}A_{ks}A_{ds}T_{ds}A_{ds}T_{ds}T_{ds}G_{ds}{}^mC_{ds}A_{ds}A_{ds}T_{ks}{}^mC_{ks}T_{ks}G_e$ | 7 | 1404 |
| 1198606 | N/A | N/A | 117331 | 117346 | TGTAATATTGCAATCT | $T_{ks}G_{ks}T_{ks}A_{ds}A_{ds}T_{ds}A_{ds}T_{ds}T_{ds}G_{ds}{}^mC_{ds}A_{ds}A_{ks}T_{ks}{}^mC_{ks}T_e$ | 25 | 2847 |
| 1198607 | N/A | N/A | 117332 | 117347 | ATGTAATATTGCAATC | $A_{ks}T_{ks}G_{ks}T_{ds}A_{ds}A_{ds}T_{ds}A_{ds}T_{ds}T_{ds}G_{ds}{}^mC_{ds}A_{ks}A_{ks}T_{ks}mC_e$ | 77 | 2848 |
| 1198608 | N/A | N/A | 117333 | 117348 | TATGTAATATTGCAAT | $T_{ks}A_{ks}T_{ks}G_{ds}T_{ds}A_{ds}A_{ds}T_{ds}A_{ds}T_{ds}T_{ds}G_{ds}{}^mC_{ks}A_{ks}A_{ks}T_e$ | 83 | 2849 |
| 1198609 | N/A | N/A | 117335 | 117350 | TTTATGTAATATTGCA | $T_{ks}T_{ks}T_{ks}A_{ds}T_{ds}G_{ds}T_{ds}A_{ds}A_{ds}T_{ds}A_{ds}T_{ds}T_{ks}G_{ks}{}^mC_{ks}A_e$ | 52 | 2850 |
| 1198610 | N/A | N/A | 117755 | 117770 | TGTATGTCAGAAGAGT | $T_{ks}G_{ks}T_{ks}A_{ds}T_{ds}G_{ds}T_{ds}{}^mC_{ds}A_{ds}G_{ds}A_{ds}A_{ds}G_{ks}A_{ks}G_{ks}T_e$ | 4 | 2863 |
| 1198611 | N/A | N/A | 117757 | 117772 | AGTGTATGTCAGAAGA | $A_{ks}G_{ks}T_{ks}G_{ds}T_{ds}A_{ds}T_{ds}G_{ds}T_{ds}{}^mC_{ds}A_{ds}G_{ds}A_{ks}A_{ks}G_{ks}A_e$ | 7 | 2864 |
| 1198612 | N/A | N/A | 117758 | 117773 | AAGTGTATGTCAGAAG | $A_{ks}A_{ks}G_{ks}T_{ds}G_{ds}T_{ds}A_{ds}T_{ds}G_{ds}T_{ds}{}^mC_{ds}A_{ds}G_{ks}A_{ks}A_{ks}G_e$ | 5 | 2865 |
| 1198613 | N/A | N/A | 117759 | 117774 | AAAGTGTATGTCAGAA | $A_{ks}A_{ks}A_{ks}G_{ds}T_{ds}G_{ds}T_{ds}A_{ds}T_{ds}G_{ds}T_{ds}{}^mC_{ds}A_{ks}G_{ks}A_{ks}A_e$ | 3 | 2866 |
| 1198614 | N/A | N/A | 117760 | 117775 | TAAAGTGTATGTCAGA | $T_{ks}A_{ks}A_{ks}A_{ds}G_{ds}T_{ds}G_{ds}T_{ds}A_{ds}T_{ds}G_{ds}T_{ds}{}^mC_{ks}A_{ks}G_{ks}A_e$ | 4 | 2867 |
| 1198615 | N/A | N/A | 117761 | 117776 | TTAAAGTGTATGTCAG | $T_{ks+1Tks}A_{ks}A_{ds}A_{ds}G_{ds}T_{ds}G_{ds}T_{ds}A_{ds}T_{ds}G_{ds}T_{ks}{}^mC_{ks}A_{ks}G_e$ | 10 | 2868 |
| 1198616 | N/A | N/A | 117762 | 117777 | TTTAAAGTGTATGTCA | $T_{ks}T_{ks}T_{ks}A_{ds}A_{ds}A_{ds}G_{ds}T_{ds}G_{ds}T_{ds}A_{ds}T_{ds}G_{ks}T_{ks}{}^mC_{ks}A_e$ | 16 | 2869 |
| 1198617 | N/A | N/A | 117763 | 117778 | CTTTAAAGTGTATGTC | ${}^mC_{ks}T_{ks}T_{ks}T_{ds}A_{ds}A_{ds}A_{ds}G_{ds}T_{ds}G_{ds}T_{ds}A_{ds}T_{ks}G_{ks}T_{ks}{}^mC_e$ | 34 | 1634 |
| 1198618 | N/A | N/A | 117765 | 117780 | AACTTTAAAGTGTATG | $A_{ks}A_{ks}{}^mC_{ks}T_{ds}T_{ds}T_{ds}A_{ds}A_{ds}A_{ds}G_{ds}T_{ds}G_{ds}T_{ks}A_{ks}T_{ks}G_e$ | 74 | 2870 |
| 1198619 | N/A | N/A | 119667 | 119682 | TAAGGTTTCCCAGATT | $T_{ks}A_{ks}A_{ks}G_{ds}G_{ds}T_{ds}T_{ds}T_{ds}{}^mC_{ds}{}^mC_{ds}{}^mC_{ds}A_{ds}G_{ks}A_{ks}T_{ks}T_e$ | 53 | 2851 |
| 1198620 | N/A | N/A | 119669 | 119684 | AGTAAGGTTTCCCAGA | $A_{ks}G_{ks}T_{ks}A_{ds}A_{ds}G_{ds}G_{ds}T_{ds}T_{ds}T_{ds}{}^mC_{ds}{}^mC_{ds}{}^mC_{ks}A_{ks}G_{ks}A_e$ | 26 | 2852 |
| 1198621 | N/A | N/A | 119670 | 119685 | AAGTAAGGTTTCCCAG | $A_{ks}A_{ks}G_{ks}T_{ds}A_{ds}A_{ds}G_{ds}G_{ds}T_{ds}T_{ds}T_{ds}{}^mC_{ds}{}^mC_{ks}{}^mC_{ks}A_{ks}G_e$ | 80 | 2853 |
| 1198622 | N/A | N/A | 119671 | 119686 | TAAGTAAGGTTTCCCA | $T_{ks}A_{ks}A_{ks}G_{ds}T_{ds}A_{ds}A_{ds}G_{ds}G_{ds}T_{ds}T_{ds}T_{ds}{}^mC_{ks}{}^mC_{ks}{}^mC_{ks}A_e$ | 26 | 2854 |
| 1198623 | N/A | N/A | 119672 | 119687 | CTAAGTAAGGTTTCCC | ${}^mC_{ks}T_{ks}A_{ks}A_{ds}G_{ds}T_{ds}A_{ds}A_{ds}G_{ds}G_{ds}T_{ds}T_{ds}T_{ks}{}^mC_{ks}{}^mC_{ks}{}^mC_e$ | 9 | 1101 |
| 1198624 | N/A | N/A | 119673 | 119688 | ACTAAGTAAGGTTTCC | $A_{ks}{}^mC_{ks}T_{ks}A_{ds}A_{ds}G_{ds}T_{ds}A_{ds}A_{ds}G_{ds}G_{ds}T_{ds}T_{ks}T_{ks}{}^mC_{ks}{}^mC_e$ | 20 | 2855 |
| 1198625 | N/A | N/A | 119674 | 119689 | GACTAAGTAAGGTTTC | $G_{ks}A_{ks}{}^mC_{ks}T_{ds}A_{ds}A_{ds}G_{ds}T_{ds}A_{ds}A_{ds}G_{ds}G_{ds}T_{ks}T_{ks}T_{ks}{}^mC_e$ | 64 | 2856 |
| 1198626 | N/A | N/A | 119675 | 119690 | AGACTAAGTAAGGTTT | $A_{ks}G_{ks}A_{ks}{}^mC_{ds}T_{ds}A_{ds}A_{ds}G_{ds}T_{ds}A_{ds}A_{ds}G_{ds}G_{ks}T_{ks}T_{ks}T_e$ | 99 | 2857 |
| 1198627 | N/A | N/A | 119677 | 119692 | TTAGACTAAGTAAGGT | $T_{ks}T_{ks}A_{ks}G_{ds}A_{ds}{}^mC_{ds}T_{ds}A_{ds}A_{ds}G_{ds}T_{ds}A_{ds}A_{ks}G_{ks}G_{ks}T_e$ | 39 | 2858 |

TABLE 51

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_k$ | 24 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ds}{}^mC_{ks}A_k$ | 9 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_k$ | 5 | 2800 |
| 1197237 | 4436 | 4451 | 125461 | 125476 | TATAACTGGGCAAATT | $T_{ks}A_{ks}T_{ks}A_{ds}A_{ys}{}^mC_{ds}T_{ds}G_{ds}G_{ds}G_{ds}{}^mC_{ds}A_{ds}A_{ds}A_{ks}T_{ks}T_k$ | 74 | 2815 |
| 1197238 | 4439 | 4454 | 125464 | 125479 | AGGTATAACTGGGCAA | $A_{ks}G_{ks}G_{ks}T_{ds}A_{ys}T_{ds}A_{ds}A_{ds}{}^mC_{ds}T_{ds}G_{ds}G_{ds}G_{ds}{}^mC_{ks}A_{ks}A_k$ | 43 | 905 |
| 1197239 | 4441 | 4456 | 125466 | 125481 | TGAGGTATAACTGGGC | $T_{ks}G_{ks}A_{ks}G_{ds}G_{ys}T_{ds}A_{ds}T_{ds}A_{ds}A_{ds}{}^mC_{ds}T_{ds}G_{ds}G_{ks}G_{ks}{}^mC_k$ | 47 | 1580 |

TABLE 51-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1197240 | 4442 | 4457 | 125467 | 125482 | CTGAGGTATAACTGGG | $^mC_{ks}T_{ks}G_{ks}A_{ds}G_{ys}G_{ds}T_{ds}A_{ds}T_{ds}A_{ds}$ $A_{ds}{}^mC_{ds}T_{ds}G_{ks}G_{ks}G_{k}$ | 58 | 2801 |
| 1197241 | 4443 | 4458 | 125468 | 125483 | ACTGAGGTATAACTGG | $A_{ks}{}^mC_{ks}T_{ks}G_{ds}A_{ys}G_{ds}G_{ds}T_{ds}A_{ds}T_{ds+1}$ $A_{ds}A_{ds}{}^mC_{ds}T_{ks}G_{ks}G_{k}$ | 19 | 392 |
| 1197242 | 4444 | 4459 | 125469 | 125484 | CACTGAGGTATAACTG | $^mC_{ks}A_{ks}{}^mC_{ks}T_{ds}G_{ys}A_{ds}G_{ds}G_{ds}T_{ds}$ $A_{ds}T_{ds}A_{ds}A_{ds}{}^mC_{ks}T_{ks}G_{k}$ | 46 | 2802 |
| 1197243 | 4446 | 4461 | 125471 | 125486 | AACACTGAGGTATAAC | $A_{ks}A_{ks}{}^mC_{ks}A_{ds}C_{ys}T_{ds}G_{ds}A_{ds}G_{ds}$ $G_{ds}T_{ds}A_{ds}T_{ds}A_{ks}A_{ks}{}^mC_{k}$ | 81 | 2816 |
| 1197248 | 4605 | 4620 | 125630 | 125645 | TTAAGCACTTTTACAT | $T_{ks}T_{ks}A_{ks}A_{ds}G_{ys}{}^mC_{ds}A_{ds}{}^mC_{ds}T_{ds}$ $T_{ds}T_{ds}T_{ds}A_{ds}{}^mC_{ks}A_{ks}T_{k}$ | 75 | 2822 |
| 1197249 | 4795 | 4810 | 125820 | 125835 | GGAAGATCTGAAACTC | $G_{ks}G_{ks}A_{ks}A_{ds}G_{ys}A_{ds}T_{ds}{}^mC_{ds}T_{ds}G_{ds}$ $A_{ds}A_{ds}A_{ds}{}^mC_{ks}T_{ks}{}^mC_{k}$ | 28 | 2823 |
| 1197250 | 4797 | 4812 | 125822 | 125837 | TTGGAAGATCTGAAAC | $T_{ks}T_{ks}G_{ks}G_{ds}A_{ys}A_{ds}G_{ds}A_{ds}T_{ds}{}^mC_{ds}$ $T_{ds}G_{ds}A_{ds}A_{ks}A_{ks}{}^mC_{k}$ | 60 | 2824 |
| 1197251 | 4798 | 4813 | 125823 | 125838 | TTTGGAAGATCTGAAA | $T_{ks}T_{ks}T_{ks}G_{ds}G_{ys}A_{ds}A_{ds}G_{ds}A_{ds}T_{ds}{}^m$ $C_{ds}T_{ds}G_{ds}A_{ks}A_{ks}A_{k}$ | 74 | 2825 |
| 1197252 | 4799 | 4814 | 125824 | 125839 | CTTTGGAAGATCTGAA | $^mC_{ks}T_{ks}T_{ks}T_{ds}G_{ys}G_{ds}A_{ds}A_{ds}G_{ds}A_{ds}$ $T_{ds}{}^mC_{ds}T_{ds}G_{ks}A_{ks}A_{k}$ | 53 | 2826 |
| 1197253 | 4803 | 4818 | 125828 | 125843 | AGTGCTTTGGAAGATC | $A_{ks}G_{ks}T_{ks}G_{ds}C_{ys}T_{ds}T_{ds}T_{ds}G_{ds}G_{ds}$ $A_{ds}A_{ds}G_{ds}A_{ks}T_{ks}{}^mC_{k}$ | 58 | 2828 |
| 1197254 | N/A | N/A | 94731 | 94746 | TTAGGATGCATGGTTT | $T_{ks}T_{ks}A_{ks}G_{ds}G_{ys}A_{ds}T_{ds}G_{ds}{}^mC_{ds}A_{ds}$ $T_{ds}G_{ds}G_{ds}T_{ks}T_{ks}T_{k}$ | 51 | 2831 |
| 1197255 | N/A | N/A | 94732 | 94747 | TTTAGGATGCATGGTT | $T_{ks}T_{ks}T_{ks}A_{ds}G_{ys}G_{ds}A_{ds}T_{ds}G_{ds}{}^mC_{ds}$ $A_{ds}T_{ds}G_{ds}G_{ks}T_{ks}T_{k}$ | 38 | 2832 |
| 1197256 | N/A | N/A | 94733 | 94748 | ATTTAGGATGCATGGT | $A_{ks}T_{ks}T_{ks}T_{ds}A_{ys}G_{ds}G_{ds}A_{ds}T_{ds}G_{ds}{}^m$ $C_{ds}A_{ds}T_{ds}G_{ks}G_{ks}T_{k}$ | 31 | 2833 |
| 1197257 | N/A | N/A | 94737 | 94752 | TCAGATTTAGGATGCA | $T_{ks}{}^mC_{ks}A_{ks}G_{ds}A_{ys}T_{ds}T_{ds}T_{ds}A_{ds}G_{ds}$ $G_{ds}A_{ds}T_{ds}G_{ks}{}^mC_{ks}A_{k}$ | 20 | 2837 |
| 1197258 | N/A | N/A | 94739 | 94754 | ATTCAGATTTAGGATG | $A_{ks+1}T_{ks}T_{ks}{}^mC_{ds}A_{ys}G_{ds}A_{ds}T_{ds}T_{ds}T_{ds}$ $A_{ds}G_{ds}A_{ds}T_{ks}G_{k}$ | 57 | 2838 |
| 1197259 | N/A | N/A | 115903 | 115918 | ATATGGTTTTGTGTGT | $A_{ks}T_{ks}A_{ks}T_{ds}G_{ys}G_{ds}T_{ds}T_{ds}T_{ds}T_{ds}$ $G_{ds}T_{ds}G_{ds}T_{ks}G_{ks}T_{k}$ | 59 | 2839 |
| 1197260 | N/A | N/A | 115905 | 115920 | TTATATGGTTTTGTGT | $T_{ks}T_{ks}A_{ks}T_{ds}A_{ys}T_{ds}G_{ds}G_{ds}T_{ds}T_{ds}$ $T_{ds}T_{ds}G_{ds}T_{ks}G_{ks}T_{k}$ | 65 | 2840 |
| 1197261 | N/A | N/A | 115907 | 115922 | TCTTATATGGTTTTGT | $T_{ks}{}^mC_{ks}T_{ks}T_{ds}A_{ys}T_{ds}A_{ds}T_{ds}G_{ds}G_{ds}$ $T_{ds}T_{ds}T_{ds}T_{ks}G_{ks}T_{k}$ | 91 | 2841 |
| 1197262 | N/A | N/A | 115910 | 115925 | AACTCTTATATGGTTT | $A_{ks}A_{ks}{}^mC_{ks}T_{ds}C_{ys}T_{ds}T_{ds}A_{ds}T_{ds}A_{ds}$ $T_{ds}G_{ds}G_{ds}T_{ks}T_{ks}T_{k}$ | 89 | 2860 |
| 1197263 | N/A | N/A | 115913 | 115928 | GACAACTCTTATATGG | $G_{ks}{}^mA_{ks}{}^mC_{ks}A_{ds}A_{ys}{}^mC_{ds}T_{ds}{}^mC_{ds}T_{ds}$ $T_{ds}A_{ds}T_{ds}A_{ds}T_{ks}G_{ks}G_{k}$ | 91 | 2862 |
| 1197264 | N/A | N/A | 117325 | 117340 | ATTGCAATCTGTCTGA | $A_{ks}T_{ks}T_{ks}G_{ds}C_{ys}A_{ds}A_{ds}T_{ds}{}^mC_{ds}T_{ds}$ $G_{ds}T_{ds}{}^mC_{ds}T_{ks}G_{ks}A_{k}$ | 33 | 2843 |
| 1197265 | N/A | N/A | 117329 | 117344 | TAATATTGCAATCTGT | $T_{ks}A_{ks}A_{ks}T_{ds}A_{ys}T_{ds}T_{ds}G_{ds}{}^mC_{ds}A_{ds}$ $A_{ds}T_{ds}{}^mC_{ds}T_{ks}G_{ks}T_{k}$ | 103 | 2846 |
| 1197266 | N/A | N/A | 117331 | 117346 | TGTAATATTGCAATCT | $T_{ks}G_{ks}T_{ks}A_{ds}A_{ys}T_{ds}A_{ds}T_{ds}T_{ds}G_{ds}{}^m$ $C_{ds}A_{ds}A_{ds}T_{ks}{}^mC_{ks}T_{k}$ | 31 | 2847 |
| 1197267 | N/A | N/A | 117332 | 117347 | ATGTAATATTGCAATC | $A_{ks}T_{ks}G_{ks}T_{ds}A_{ys}A_{ds}T_{ds}A_{ds}T_{ds}T_{ds}$ $G_{ds}{}^mC_{ds}A_{ds}A_{ks}T_{ks}{}^mC_{k}$ | 62 | 2848 |
| 1197268 | N/A | N/A | 117758 | 117773 | AAGTGTATGTCAGAAG | $A_{ks}A_{ks}G_{ks}T_{ds}G_{ys}T_{ds}A_{ds}T_{ds}G_{ds}T_{ds}{}^m$ $C_{ds}A_{ds}G_{ds}A_{ks}A_{ks}G_{k}$ | 25 | 2865 |
| 1197269 | N/A | N/A | 117760 | 117775 | TAAAGTGTATGTCAGA | $T_{ks}A_{ks}A_{ks}A_{ds}G_{ys}T_{ds}G_{ds}T_{ds}A_{ds}T_{ds}$ $G_{ds}T_{ds}{}^mC_{ds}A_{ks}G_{ks}A_{k}$ | 3 | 2867 |
| 1197270 | N/A | N/A | 117761 | 117776 | TTAAAGTGTATGTCAG | $T_{ks}T_{ks}A_{ks}A_{ds}A_{ys}G_{ds}T_{ds}G_{ds}T_{ds}A_{ds}$ $T_{ds}G_{ds}T_{ds}{}^mC_{ks}A_{ks}G_{k}$ | 2 | 2868 |
| 1197271 | N/A | N/A | 117762 | 117777 | TTTAAAGTGTATGTCA | $T_{ks}T_{ks}T_{ks}A_{ds}A_{ys}A_{ds}G_{ds}T_{ds}G_{ds}T_{ds}$ $A_{ds}T_{ds}G_{ds}T_{ks}{}^mC_{ks}A_{k}$ | 12 | 2869 |
| 1197272 | N/A | N/A | 117763 | 117778 | CTTTAAAGTGTATGTC | $^mC_{ks}T_{ks}T_{ks}T_{ds}A_{ys}A_{ds}A_{ds}G_{ds}T_{ds}G_{ds}$ $T_{ds}A_{ds}T_{ds}G_{ks}T_{ks}{}^mC_{k}$ | 32 | 1634 |
| 1197273 | N/A | N/A | 119667 | 119682 | TAAGGTTTCCCAGATT | $T_{ks}A_{ks}A_{ks}G_{ds}G_{ys}T_{ds}T_{ds}T_{ds}{}^mC_{ds}{}^m$ $C_{ds}{}^mC_{ds}A_{ds}G_{ds}A_{ks}T_{ks}T_{k}$ | 68 | 2851 |
| 1197274 | N/A | N/A | 119669 | 119684 | AGTAAGGTTTCCCAGA | $A_{ks}G_{ks}T_{ks}A_{ds}A_{ys}G_{ds}G_{ds}T_{ds}T_{ds}T_{ds}{}^m$ $C_{ds}{}^mC_{ds}{}^mC_{ds}A_{ks}G_{ks}A_{k}$ | 31 | 2852 |
| 1197275 | N/A | N/A | 119670 | 119685 | AAGTAAGGTTTCCCAG | $A_{ks}A_{ks}G_{ks}T_{ds}A_{ys}A_{ds}G_{ds}G_{ds}T_{ds}T_{ds}$ $T_{ds}{}^mC_{ds}{}^mC_{ds}{}^mC_{ks}A_{ks}G_{k}$ | 30 | 2853 |
| 1197276 | N/A | N/A | 119672 | 119687 | CTAAGTAAGGTTTCCC | $^mC_{ks}T_{ks}A_{ks}A_{ds}G_{ys}T_{ds}A_{ds}A_{ds}G_{ds}G_{ds}$ $T_{ds}T_{ds}T_{ds}{}^mC_{ks}{}^mC_{ks}{}^mC_{k}$ | 44 | 1101 |
| 1197277 | N/A | N/A | 119673 | 119688 | ACTAAGTAAGGTTTCC | $A_{ks}{}^mC_{ks}T_{ks}A_{ds}A_{ys}G_{ds}T_{ds}A_{ds}A_{ds}G_{ds}$ $G_{ds}T_{ds}T_{ds}T_{ks}{}^mC_{ks}{}^mC_{k}$ | 23 | 2855 |
| 1197278 | N/A | N/A | 119674 | 119689 | GACTAAGTAAGGTTTC | $G_{ks}A_{ks}{}^mC_{ks}T_{ds}A_{ys}A_{ds}G_{ds}T_{ds}A_{ds}A_{ds}$ $G_{ds}G_{ds}T_{ds}T_{ks}T_{ks}{}^mC_{k}$ | 36 | 2856 |
| 1197279 | N/A | N/A | 119677 | 119692 | TTAGACTAAGTAAGGT | $T_{ks}T_{ks}A_{ks}G_{ds}A_{ys}{}^mC_{ds}T_{ds}A_{ds}A_{ds}G_{ds}$ $T_{ds}A_{ds}A_{ds}G_{ks}G_{ks}T_{k}$ | 54 | 2858 |

TABLE 51-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMISTRY NOTATION | YAP1 SEQ YAP1 (% UT) | SEQ ID NO |
|---|---|---|---|---|---|---|---|---|
| 1197289 | 4438 | 4453 | 125463 | 125478 | GGTAUAACTGGGCAAA | $G_{ks}G_{ks}T_{ks}A_{ds}U_{ys}A_{ds}A_{ds}{}^mC_{ds}T_{ds}G_{ds}G_{ds}G_{ds}{}^mC_{ds}A_{ks}A_k$ | 48 | 2884 |
| 1197290 | 4440 | 4455 | 125465 | 125480 | GAGGUATAACTGGGCA | $G_{ks}A_{ks}G_{ks}G_{ds}U_{ys}A_{ds}T_{ds}A_{ds}A_{ds}{}^mC_{ds}T_{ds}G_{ds}G_{ds}G_{ks}{}^mC_{ks}A_k$ | 37 | 2885 |
| 1197295 | 4800 | 4815 | 125825 | 125840 | GCTTUGGAAGATCTGA | $G_{ks}{}^mC_{ks}T_{ks}T_{ds}U_{ys}G_{ds}G_{ds}A_{ds}A_{ds}G_{ds}A_{ds}T_{ds}C_{ds}T_{ks}G_{ks}A_k$ | 24 | 2886 |
| 1197296 | 4801 | 4816 | 125826 | 125841 | TGCTUTGGAAGATCTG | $T_{ks}G_{ks}{}^mC_{ks}T_{ds}U_{ys}T_{ds}G_{ds}G_{ds}A_{ds}A_{ds}G_{ds}A_{ds}T_{ds}{}^mC_{ks}T_{ks}G_k$ | 36 | 2887 |
| 1197297 | 4802 | 4817 | 125827 | 125842 | GTGCUTTGGAAGATCT | $G_{ks}T_{ks}G_{ks}{}^mC_{ds}U_{ys}T_{ds}T_{ds}G_{ds}G_{ds}A_{ds}A_{ds}G_{ds}A_{ds}T_{ks}{}^mC_{ks}T_k$ | 25 | 2888 |
| 1197298 | 4805 | 4820 | 125830 | 125845 | ATAGUGCTTTGGAAGA | $A_{ks}T_{ks}A_{ks}G_{ds}U_{ys}G_{ds}{}^mC_{ds}T_{ds}T_{ds}T_{ds}G_{ds}G_{ds}A_{ds}A_{ks}G_{ks}A_k$ | 46 | 2889 |
| 1197299 | N/A | N/A | 94729 | 94744 | AGGAUGCATGGTTTTT | $A_{ks}G_{ks}G_{ks}A_{ds}U_{ys}G_{ds}{}^mC_{ds}A_{ds}T_{ds}G_{ds}G_{ds}T_{ds}T_{ds}T_{ks}T_{ks}T_k$ | 41 | 2890 |
| 1197300 | N/A | N/A | 94734 | 94749 | GATTUAGGATGCATGG | $G_{ks}A_{ks}T_{ks}T_{ds}U_{ys}A_{ds}G_{ds}G_{ds}A_{ds}T_{ds}G_{ds}{}^mC_{ds}A_{ds}T_{ks}G_{ks}G_k$ | 42 | 2891 |
| 1197301 | N/A | N/A | 94735 | 94750 | AGATUAGGATGCATG | $A_{ks}A_{ks}A_{ds}T_{ds}U_{ys}A_{ds}G_{ds}G_{ds}A_{ds}T_{ds}G_{ds}{}^mC_{ds}A_{ks}T_{ks}G_k$ | 71 | 2892 |
| 1197302 | N/A | N/A | 94736 | 94751 | CAGAUTAGGATGCAT | ${}^mC_{ks}A_{ks}G_{ks}A_{ds}U_{ys}T_{ds}A_{ds}G_{ds}G_{ds}A_{ds}T_{ds}G_{ds}{}^mC_{ks}A_{ks}T_k$ | 54 | 2893 |
| 1197303 | N/A | N/A | 115906 | 115921 | CTTAUATGGTTTTGTG | ${}^mC_{ks}T_{ks}T_{ks}A_{ds}U_{ys}A_{ds}T_{ds}G_{ds}G_{ds}T_{ds}T_{ds}T_{ds}G_{ks}T_{ks}G_k$ | 72 | 2894 |
| 1197304 | N/A | N/A | 115908 | 115923 | CTCTUATATGGTTTTG | ${}^mC_{ks}T_{ks}{}^mC_{ks}T_{ds}U_{ys}A_{ds}T_{ds}A_{ds}T_{ds}G_{ds}G_{ds}T_{ds}T_{ds}T_{ks}T_{ks}G_k$ | 45 | 2895 |
| 1197305 | N/A | N/A | 115909 | 115924 | ACTCUTATATGGTTTT | $A_{ks}{}^mC_{ks}T_{ks}{}^mC_{ds}U_{ys}T_{ds}A_{ds}T_{ds}A_{ds}T_{ds}G_{ds}G_{ds}T_{ds}T_{ks}T_{ks}T_k$ | 30 | 2896 |
| 1197306 | N/A | N/A | 115911 | 115926 | CAACUCTTATATGGTT | ${}^mC_{ks}A_{ks}A_{ks}{}^mC_{ds}U_{ys}{}^mC_{ds}T_{ds}T_{ds}A_{ds}T_{ds}A_{ds}T_{ds}G_{ds}G_{ks}T_{ks}T_k$ | 77 | 2897 |
| 1197307 | N/A | N/A | 117327 | 117342 | ATATUGCAATCTGTCT | $A_{ks}T_{ks}A_{ks}T_{ds}U_{ys}G_{ds}{}^mC_{ds}A_{ds}A_{ds}T_{ds}{}^mC_{ds}T_{ds}G_{ds}T_{ks}{}^mC_{ks}T_k$ | 88 | 2898 |
| 1197308 | N/A | N/A | 117328 | 117343 | AATAUTGCAATCTGTC | $A_{ks}A_{ks}T_{ks}A_{ds}U_{ys}T_{ds}G_{ds}{}^mC_{ds}A_{ds}A_{ds}T_{ds}{}^mC_{ds}T_{ds}G_{ks}T_{ks}{}^mC_k$ | 49 | 2899 |
| 1197309 | N/A | N/A | 117330 | 117345 | GTAAUATTGCAATCTG | $G_{ks}T_{ks}A_{ks}A_{ds}U_{ys}A_{ds}T_{ds}T_{ds}G_{ds}{}^mC_{ds}A_{ds}A_{ds}T_{ds}{}^mC_{ks}T_{ks}G_k$ | 11 | 2900 |
| 1197310 | N/A | N/A | 117333 | 117348 | TATGUAATATTGCAAT | $T_{ks}A_{ks}T_{ks}G_{ds}U_{ys}A_{ds}A_{ds}T_{ds}A_{ds}T_{ds}T_{ds}G_{ds}{}^mC_{ds}A_{ks}A_{ks}T_k$ | 109 | 2901 |
| 1197311 | N/A | N/A | 117335 | 117350 | TTTAUGTAATATTGCA | $T_{ks}T_{ks}T_{ks}A_{ds}U_{ys}G_{ds}T_{ds}A_{ds}A_{ds}T_{ds}A_{ds}T_{ds}T_{ds}G_{ks}{}^mC_{ks}A_k$ | 27 | 2902 |
| 1197312 | N/A | N/A | 117755 | 117770 | TGTAUGTCAGAAGAGT | $T_{ks}G_{ks}T_{ks}A_{ds}U_{ys}G_{ds}T_{ds}{}^mC_{ds}A_{ds}G_{ds}A_{ds}A_{ds}G_{ds}A_{ks}G_{ks}T_k$ | 10 | 2903 |
| 1197313 | N/A | N/A | 117757 | 117772 | AGTGUATGTCAGAAGA | $A_{ks}G_{ks}T_{ks}G_{ds}U_{ys}A_{ds}T_{ds}G_{ds}T_{ds}{}^mC_{ds}A_{ds}G_{ds}A_{ds}A_{ks}G_{ks}A_k$ | 8 | 2904 |
| 1197314 | N/A | N/A | 117759 | 117774 | AAAGUGTATGTCAGAA | $A_{ks}A_{ks}A_{ds}G_{ds}U_{ys}G_{ds}T_{ds}A_{ds}T_{ds}G_{ds}T_{ds}{}^mC_{ds}A_{ds}G_{ks}A_{ks}A_k$ | 22 | 2905 |
| 1197315 | N/A | N/A | 117765 | 117780 | AACTUTAAAGTGTATG | $A_{ks}A_{ks}{}^mC_{ks}T_{ds}U_{ys}T_{ds}A_{ds}A_{ds}A_{ds}G_{ds}T_{ds}G_{ds}T_{ds}A_{ks}T_{ks}G_k$ | 116 | 2906 |
| 1197316 | N/A | N/A | 119671 | 119686 | TAAGUAAGGTTTCCCA | $T_{ks}A_{ks}A_{ks}G_{ds}U_{ys}A_{ds}A_{ds}G_{ds}G_{ds}T_{ds}T_{ds}T_{ds}{}^mC_{ds}{}^mC_{ds}{}^mC_{ks}A_k$ | 46 | 2907 |
| 1197317 | N/A | N/A | 119675 | 119690 | AGACUAAGTAAGGTTT | $A_{ks}G_{ks}A_{ks}{}^mC_{ds}U_{ys}A_{ds}A_{ds}G_{ds}T_{ds}A_{ds}A_{ds}G_{ds}G_{ds}T_{ks}T_{ks}T_k$ | 78 | 2908 |
| 1200784 | 2524 | 2539 | 123549 | 123564 | TGTCTCATGCCTTATA | $T_{ks}G_{ks}T_{ks}{}^mC_{ds}T_{ds}{}^mC_{ds}A_{ds}T_{ds}G_{ds}{}^mC_{ds}{}^mC_{ds}T_{ds}T_{ds}A_{ks}T_{ks}A_k$ | 19 | 2803 |
| 1200785 | 2526 | 2541 | 123551 | 123566 | ATTGTCTCATGCCTTA | $A_{ks}T_{ks}T_{ks}G_{ds}T_{ds}{}^mC_{ds}T_{ds}{}^mC_{ds}A_{ds}T_{ds}G_{ds}{}^mC_{ds}{}^mC_{ds}T_{ks}T_{ks}A_k$ | 15 | 2804 |
| 1200786 | 2527 | 2542 | 123552 | 123567 | AATTGUCTCATGCCTT | $A_{ks}A_{ks}T_{ds}T_{ds}G_{ds}U_{ys}{}^mC_{ds}T_{ds}{}^mC_{ds}A_{ds}T_{ds}G_{ds}{}^mC_{ds}{}^mC_{ks}T_{ks}T_k$ | 21 | 2909 |
| 1200787 | 2528 | 2543 | 123553 | 123568 | AAATTGTCTCATGCCT | $A_{ks}A_{ks}A_{ks}T_{ds}T_{ds}G_{ds}T_{ds}{}^mC_{ds}T_{ds}{}^mC_{ds}A_{ds}T_{ds}G_{ds}{}^mC_{ks}{}^mC_{ks}T_k$ | 38 | 443 |
| 1200793 | 2560 | 2575 | 123585 | 123600 | AGTATGTGGCAATAAT | $A_{ks}G_{ks}T_{ks}A_{ds}T_{ds}G_{ds}T_{ds}G_{ds}G_{ds}{}^mC_{ds}A_{ds}A_{ds}T_{ds}A_{ks}A_{ks}T_k$ | 31 | 2809 |
| 1200794 | 2562 | 2577 | 123587 | 123602 | AGAGTATGTGGCAATA | $A_{ks}G_{ks}A_{ks}G_{ds}T_{ds}A_{ys}T_{ds}G_{ds}T_{ds}G_{ds}G_{ds}{}^mC_{ds}A_{ds}A_{ks}T_{ks}A_k$ | 18 | 2810 |
| 1200795 | 2563 | 2578 | 123588 | 123603 | TAGAGUATGTGGCAAT | $T_{ks}A_{ks}G_{ks}A_{ds}G_{ds}U_{ys}A_{ds}T_{ds}G_{ds}T_{ds}G_{ds}G_{ds}{}^mC_{ds}A_{ks}A_{ks}T_k$ | 30 | 2910 |
| 1200796 | 2564 | 2579 | 123589 | 123604 | TTAGAGTATGTGGCAA | $T_{ks}T_{ks}A_{ks}G_{ds}A_{ds}G_{ds}T_{ds}A_{ds}T_{ds}G_{ds}T_{ds}G_{ds}G_{ds}{}^mC_{ks}A_{ks}A_k$ | 15 | 963 |
| 1200797 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_k$ | 11 | 810 |
| 1200798 | 2566 | 2581 | 123591 | 123606 | TATTAGAGTATGTGGC | $T_{ks}A_{ks}T_{ks}T_{ds}A_{ds}G_{ds}A_{ds}G_{ds}T_{ds}A_{ds}T_{ds}G_{ds}T_{ds}G_{ks}G_{ks}{}^mC_k$ | 7 | 2812 |
| 1200799 | 2567 | 2582 | 123592 | 123607 | ATATTAGAGTATGTGG | $A_{ks}T_{ks}A_{ks}T_{ds}T_{ds}A_{ds}G_{ys}A_{ds}G_{ds}T_{ds}A_{ds}T_{ds}G_{ds}T_{ks}G_{ks}G_k$ | 27 | 2813 |

TABLE 51-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1200800 | 2568 | 2583 | 123593 | 123608 | TATATUAGAGTATGTG | $T_{ks}A_{ks}T_{ks}A_{ds}T_{ds}U_{ys}A_{ds}G_{ds}A_{ds}G_{ds}T_{ds}A_{ds}T_{ds}G_{ks}T_{ks}G_{k}$ | 61 | 2911 |
| 1200801 | 2570 | 2585 | 123595 | 123610 | TCTATATTAGAGTATG | $T_{ks}{}^mC_{ks}T_{ks}A_{ds}T_{ds}A_{ys}T_{ds}T_{ds}A_{ds}G_{ds}A_{ds}G_{ds}T_{ds}A_{ks}T_{ks}G_{k}$ | 77 | 887 |

TABLE 52

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 715487 | 3630 | 3645 | 124655 | 124670 | ATTACTTCATAGCTTA | $A_{ks}T_{ks}T_{ks}A_{ds}{}^mC_{ds}T_{ds}T_{ds}{}^mC_{ds}A_{ds}T_{ds}A_{ds}G_{ds}{}^mC_{ds}T_{ks}T_{ks}A_{k}$ | 29 | 52 |
| 958499 | 2565 | 2580 | 123590 | 123605 | ATTAGAGTATGTGGCA | $A_{ks}T_{ks}T_{ks}A_{ds}G_{ds}A_{ds}G_{ds}T_{ds}A_{ds}T_{ds}G_{ds}T_{ds}G_{ds}G_{ks}{}^mC_{ks}A_{k}$ | 14 | 810 |
| 1074461 | 2529 | 2544 | 123554 | 123569 | GAAATTGTCTCATGCC | $G_{ks}A_{ks}A_{ks}A_{ds}T_{ds}T_{ds}G_{ds}T_{ds}{}^mC_{ds}T_{ds}{}^mC_{ds}A_{ds}T_{ds}G_{ks}{}^mC_{ks}{}^mC_{k}$ | 15 | 2800 |
| 1200788 | 2529 | 2544 | 123554 | 123569 | GAAATUGTCTCATGCC | $G_{ks}A_{ks}A_{ks}A_{ds}T_{ds}U_{ys}G_{ds}T_{ds}{}^mC_{ds}T_{ds}{}^mC_{ds}A_{ds}T_{ds}G_{ks}{}^mC_{ks}{}^mC_{k}$ | 19 | 2912 |
| 1200789 | 2530 | 2545 | 123555 | 123570 | GGAAAUTGTCTCATGC | $G_{ks}G_{ks}A_{ks}A_{ds}A_{ds}U_{ys}T_{ds}G_{ds}T_{ds}{}^mC_{ds}T_{ds}{}^mC_{ds}A_{ds}T_{ks}G_{ks}{}^mC_{k}$ | 12 | 2913 |
| 1200790 | 2531 | 2546 | 123556 | 123571 | TGGAAATTGTCTCATG | $T_{ks}G_{ks}G_{ks}A_{ds}A_{ds}A_{ys}T_{ds}T_{ds}G_{ds}T_{ds}{}^mC_{ds}T_{ds}{}^mC_{ds}A_{ks}T_{ks}G_{k}$ | 33 | 2807 |
| 1200791 | 2532 | 2547 | 123557 | 123572 | ATGGAAATTGTCTCAT | $A_{ks}T_{ks}G_{ks}G_{ds}A_{ds}A_{ys}A_{ds}T_{ds}T_{ds}G_{ds}T_{ds}{}^mC_{ds}T_{ds}{}^mC_{ks}A_{ks}T_{k}$ | 46 | 2808 |
| 1200792 | 2534 | 2549 | 123559 | 123574 | ATATGGAAATTGTCTC | $A_{ks}T_{ks}A_{ks}T_{ds}G_{ds}G_{ys}A_{ds}A_{ds}A_{ds}T_{ds}T_{ds}G_{ds}T_{ds}{}^mC_{ks}T_{ks}{}^mC_{k}$ | 52 | 656 |
| 1200802 | 4436 | 4451 | 125461 | 125476 | TATAACTGGGCAAATT | $T_{ks}A_{ks}T_{ks}A_{ds}A_{ds}{}^mC_{ys}T_{ds}G_{ds}G_{ds}G_{ds}{}^mC_{ds}A_{ds}A_{ds}A_{ks}T_{k}$ | 89 | 2815 |
| 1200803 | 4438 | 4453 | 125463 | 125478 | GGTATAACTGGGCAAA | $G_{ks}G_{ks}T_{ks}A_{ds}T_{ds}A_{ys}A_{ds}{}^mC_{ds}T_{ds}G_{ds}G_{ds}G_{ds}{}^mC_{ks}A_{ks}A_{k}$ | 22 | 1427 |
| 1200804 | 4439 | 4454 | 125464 | 125479 | AGGTAUAACTGGGCAA | $A_{ks}G_{ks}G_{ks}T_{ds}A_{ds}U_{ys}A_{ds}A_{ds}{}^mC_{ds}T_{ds}G_{ds}G_{ds}G_{ds}{}^mC_{ks}A_{ks}A_{k}$ | 44 | 2914 |
| 1200805 | 4440 | 4455 | 125465 | 125480 | GAGGTATAACTGGGCA | $G_{ks}A_{ks}G_{ks}G_{ds}T_{ds}A_{ys}T_{ds}A_{ds}A_{ds}{}^mC_{ds}T_{ds}G_{ds}G_{ds}G_{ks}{}^mC_{k}A_{k}$ | 50 | 1503 |
| 1200806 | 4441 | 4456 | 125466 | 125481 | TGAGGUATAACTGGGC | $T_{ks}G_{ks}A_{ks}G_{ds}G_{ds}U_{ys}A_{ds}T_{ds}A_{ds}A_{ds}{}^mC_{ds}T_{ds}G_{ds}G_{ks}G_{ks}{}^mC_{k}$ | 24 | 2915 |
| 1200807 | 4442 | 4457 | 125467 | 125482 | CTGAGGTATAACTGGG | ${}^mC_{ks}T_{ks}G_{ks}A_{ds}G_{ds}G_{ys}T_{ds}A_{ds}T_{ds}A_{ds}A_{ds}{}^mC_{ds}T_{ds}G_{ks}G_{ks}G_{k}$ | 69 | 2801 |
| 1200808 | 4443 | 4458 | 125468 | 125483 | ACTGAGGTATAACTGG | $A_{ks}{}^mC_{ks}T_{ks}G_{ds}A_{ds}G_{ys}G_{ds}T_{ds}A_{ds}T_{ds}A_{ds}A_{ds}{}^mC_{ds}T_{ks}G_{ks}G_{k}$ | 45 | 392 |
| 1200809 | 4444 | 4459 | 125469 | 125484 | CACTGAGGTATAACTG | ${}^mC_{ks}A_{ks}{}^mC_{ks}T_{ds}G_{ds}A_{ys}G_{ds}G_{ds}T_{ds}A_{ds}T_{ds}A_{ds}A_{ds}{}^mC_{ks}T_{ks}G_{k}$ | 69 | 2802 |
| 1200810 | 4446 | 4461 | 125471 | 125486 | AACACUGAGGTATAAC | $A_{ks}A_{ks}{}^mC_{ks}A_{ds}{}^mC_{ds}U_{ys}G_{ds}A_{ds}G_{ds}G_{ds}T_{ds}A_{ds}T_{ds}A_{ks}A_{ks}{}^mC_{k}$ | 94 | 2916 |
| 1200811 | 4595 | 4610 | 125620 | 125635 | TTACAUTAGGAACAAG | $T_{ks}T_{ks}A_{ks}{}^mC_{ds}A_{ds}U_{ys}T_{ds}A_{ds}G_{ds}G_{ds}A_{ds}A_{ds}{}^mC_{ks}A_{ks}A_{ks}G_{k}$ | 62 | 2917 |
| 1200812 | 4597 | 4612 | 125622 | 125637 | TTTTACATTAGGAACA | $T_{ks}T_{ks}T_{ks}T_{ds}A_{ds}C_{ys}A_{ds}T_{ds}T_{ds}A_{ds}G_{ds}G_{ds}A_{ds}A_{ks}{}^mC_{ks}A_{k}$ | 59 | 2928 |
| 1200813 | 4598 | 4613 | 125623 | 125638 | CTTTTACATTAGGAAC | ${}^mC_{ks}T_{ks}T_{ks}T_{ds}T_{ds}A_{ys}{}^mC_{ds}A_{ds}T_{ds}A_{ds}G_{ds}G_{ds}A_{ks}A_{ks}{}^mC_{k}$ | 58 | 1124 |
| 1200814 | 4599 | 4614 | 125624 | 125639 | ACTTTUACATTAGGAA | $A_{ks}{}^mC_{ks}T_{ks}T_{ds}T_{ds}U_{ys}A_{ds}{}^mC_{ds}A_{ds}T_{ds}T_{ds}A_{ds}G_{ds}G_{ks}A_{ks}A_{k}$ | 73 | 2918 |
| 1200815 | 4600 | 4615 | 125625 | 125640 | CACTTUTACATTAGGA | ${}^mC_{ks}A_{ks}{}^mC_{ks}T_{ds}T_{ds}U_{ys}T_{ds}A_{ds}{}^mC_{ds}A_{ds}T_{ds}T_{ds}A_{ds}G_{ks}G_{ks}A_{k}$ | 55 | 2919 |
| 1200816 | 4601 | 4616 | 125626 | 125641 | GCACTUTTACATTAGG | $G_{ks}{}^mC_{ks}A_{ks}{}^mC_{ds}T_{ds}U_{ys}T_{ds}T_{ds}A_{ds}{}^mC_{ds}A_{ds}T_{ds}T_{ds}A_{ks}G_{ks}G_{k}$ | 37 | 2920 |
| 1200817 | 4602 | 4617 | 125627 | 125642 | AGCACTUTTACATTAG | $A_{ks}G_{ks}{}^mC_{ks}A_{ds}{}^mC_{ds}U_{ys}T_{ds}T_{ds}T_{ds}A_{ds}{}^mC_{ds}A_{ds}T_{ds}T_{ks}A_{ks}G_{k}$ | 38 | 2921 |
| 1200818 | 4603 | 4618 | 125628 | 125643 | AAGCACTTTTACATTA | $A_{ks}A_{ks}G_{ks}{}^mC_{ds}A_{ds}C_{ys}T_{ds}T_{ds}T_{ds}T_{ds}A_{ds}{}^mC_{ds}A_{ds}T_{ks}T_{ks}A_{k}$ | 31 | 2821 |
| 1200819 | 4605 | 4620 | 125630 | 125645 | TTAAGCACTTTTACAT | $T_{ks}T_{ks}A_{ks}A_{ds}G_{ds}{}^mC_{ys}A_{ds}{}^mC_{ds}T_{ds}T_{ds}T_{ds}T_{ds}A_{ds}{}^mC_{ks}A_{ks}T_{k}$ | 101 | 2822 |
| 1200820 | 4795 | 4810 | 125820 | 125835 | GGAAGATCTGAAACTC | $G_{ks}G_{ks}A_{ks}A_{ds}G_{ds}A_{ys}T_{ds}{}^mC_{ds}T_{ds}G_{ds}A_{ds}A_{ds}A_{ds}{}^mC_{ks}T_{ks}{}^mC_{k}$ | 24 | 2823 |

TABLE 52-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1200821 | 4797 | 4812 | 125822 | 125837 | TTGGAAGATCTGAAAC | $T_{ks}T_{ks}G_{ks}G_{ds}A_{ds}A_{ys}G_{ds}A_{ds}T_{ds}{}^{m}C_{ds}T_{ds}G_{ds}A_{ds}A_{ks}A_{ks}{}^{m}C_{k}$ | 59 | 2824 |
| 1200822 | 4798 | 4813 | 125823 | 125838 | TTTGGAAGATCTGAAA | $T_{ks}T_{ks}T_{ks}G_{ds}G_{ds}A_{ys}A_{ds}G_{ds}A_{ds}T_{ds}{}^{m}C_{ds}T_{ds}G_{ds}A_{ds}A_{ks}A_{ks}A_{k}$ | 55 | 2938 |
| 1200823 | 4799 | 4814 | 125824 | 125839 | CTTTGGAAGATCTGAA | ${}^{m}C_{ks}T_{ks}T_{ks}T_{ds}G_{ds}G_{ys}A_{ds}A_{ds}G_{ds}A_{ds}T_{ds}{}^{m}C_{ds}T_{ds}G_{ks}A_{ks}A_{k}$ | 46 | 2826 |
| 1200824 | 4800 | 4815 | 125825 | 125840 | GCTTTGGAAGATCTGA | $G_{ks}{}^{m}C_{ks}T_{ks}T_{ds}T_{ds}G_{ys}G_{ds}A_{ds}A_{ds}G_{ds}A_{ds}T_{ds}{}^{m}C_{ds}T_{ds}G_{ks}A_{k}$ | 43 | 2044 |
| 1200825 | 4801 | 4816 | 125826 | 125841 | TGCTTUGGAAGATCTG | $T_{ks}G_{ks}{}^{m}C_{ks}T_{ds}T_{ds}U_{ys}G_{ds}G_{ds}A_{ds}A_{ds}G_{ds}A_{ds}T_{ds}{}^{m}C_{ks}T_{ks}G_{k}$ | 39 | 2922 |
| 1200826 | 4802 | 4817 | 125827 | 125842 | GTGCTUTGGAAGATCT | $G_{ks}T_{ks}G_{ks}{}^{m}C_{ds}T_{ds}U_{ys}T_{ds}G_{ds}G_{ds}A_{ds}A_{ds}G_{ds}A_{ds}T_{ks}{}^{m}C_{ks}T_{k}$ | 26 | 2923 |
| 1200827 | 4803 | 4818 | 125828 | 125843 | AGTGCUTTGGAAGATC | $A_{ks}G_{ks}T_{ks}G_{ds}{}^{m}C_{ds}U_{ys}T_{ds}T_{ds}G_{ds}G_{ds}A_{ds}A_{ds}G_{ds}A_{ks}T_{ks}{}^{m}C_{k}$ | 67 | 2924 |
| 1200828 | 4805 | 4820 | 125830 | 125845 | ATAGTGCTTTGGAAGA | $A_{ks}T_{ks}A_{ks}G_{ds}T_{ds}G_{ys}{}^{m}C_{ds}T_{ds}T_{ds}T_{ds}G_{ds}G_{ds}A_{ds}A_{ks}G_{ks}A_{k}$ | 54 | 2829 |
| 1200829 | N/A | N/A | 94729 | 94744 | AGGATGCATGGTTTTT | $A_{ks}G_{ks}G_{ks}A_{ds}T_{ds}G_{ys}{}^{m}C_{ds}A_{ds}T_{ds}G_{ds}G_{ds}T_{ds}T_{ks}T_{ks}T_{k}$ | 49 | 2830 |
| 1200830 | N/A | N/A | 94731 | 94746 | TTAGGATGCATGGTTT | $T_{ks}T_{ks}A_{ks}G_{ds}G_{ds}A_{ys}T_{ds}G_{ds}{}^{m}C_{ds}A_{ds}T_{ds}G_{ds}G_{ds}T_{ks}T_{ks}T_{k}$ | 50 | 2831 |
| 1200831 | N/A | N/A | 94732 | 94747 | TTTAGGATGCATGGTT | $T_{ks}T_{ks}T_{ks}A_{ds}G_{ds}G_{ys}A_{ds}T_{ds}G_{ds}{}^{m}C_{ds}A_{ds}T_{ds}G_{ds}G_{ks}T_{ks}T_{k}$ | 42 | 2832 |
| 1200832 | N/A | N/A | 94733 | 94748 | ATTTAGGATGCATGGT | $A_{ks}T_{ks}T_{ks}T_{ds}A_{ds}G_{ys}G_{ds}A_{ds}T_{ds}G_{ds}{}^{m}C_{ds}A_{ds}T_{ds}G_{ks}G_{ks}T_{k}$ | 61 | 2833 |
| 1200833 | N/A | N/A | 94734 | 94749 | GATTTAGGATGCATGG | $G_{ks}A_{ks}T_{ks}T_{ds}T_{ds}A_{ys}G_{ds}G_{ds}A_{ds}T_{ds}G_{ds}{}^{m}C_{ds}A_{ds}T_{ks}G_{ks}G_{k}$ | 31 | 2834 |
| 1200834 | N/A | N/A | 94735 | 94750 | AGATTAGGATGCATG | $A_{ks}G_{ks}A_{ks}T_{ds}T_{ds}U_{ys}A_{ds}G_{ds}G_{ds}A_{ds}T_{ds}G_{ds}{}^{m}C_{ds}A_{ks}T_{ks}G_{k}$ | 37 | 2925 |
| 1200835 | N/A | N/A | 94736 | 94751 | CAGATUTAGGATGCAT | ${}^{m}C_{ks}A_{ks}G_{ks}A_{ds}T_{ds}U_{ys}T_{ds}A_{ds}G_{ds}G_{ds}A_{ds}T_{ds}G_{ds}{}^{m}C_{ks}A_{ks}T_{k}$ | 82 | 2926 |
| 1200836 | N/A | N/A | 94737 | 94752 | TCAGAUTTAGGATGCA | $T_{ks}{}^{m}C_{ks}A_{ks}G_{ds}A_{ds}U_{ys}T_{ds}T_{ds}A_{ds}G_{ds}G_{ds}A_{ds}T_{ds}G_{ks}{}^{m}C_{ks}A_{k}$ | 72 | 2927 |
| 1200837 | N/A | N/A | 94739 | 94754 | ATTCAGATTTAGGATG | $A_{ks}T_{ks}T_{ks}{}^{m}C_{ds}A_{ds}G_{ys}A_{ds}T_{ds}T_{ds}T_{ds}A_{ds}G_{ds}G_{ds}A_{ks}T_{ks}G_{k}$ | 82 | 2838 |
| 1200838 | N/A | N/A | 115903 | 115918 | ATATGGTTTTGTGTGT | $A_{ks}T_{ks}A_{ks}T_{ds}G_{ds}G_{ys}T_{ds}T_{ds}T_{ds}T_{ds}G_{ds}T_{ds}G_{ds}T_{ks}G_{ks}T_{k}$ | 65 | 2839 |
| 1200839 | N/A | N/A | 115905 | 115920 | TTATAUGGTTTTGTGT | $T_{ks}T_{ks}A_{ks}T_{ds}A_{ds}U_{ys}G_{ds}G_{ds}T_{ds}T_{ds}T_{ds}T_{ds}G_{ds}T_{ks}G_{ks}T_{k}$ | 44 | 2928 |
| 1200840 | N/A | N/A | 115906 | 115921 | CTTATATGGTTTTGTG | ${}^{m}C_{ks}T_{ks}T_{ks}A_{ds}T_{ds}A_{ys}T_{ds}G_{ds}G_{ds}T_{ds}T_{ds}T_{ds}T_{ds}G_{ks}T_{ks}G_{k}$ | 48 | 2788 |
| 1200841 | N/A | N/A | 115907 | 115922 | TCTTAUATGGTTTTGT | $T_{ks}{}^{m}C_{ks}T_{ks}T_{ds}A_{ds}U_{ys}A_{ds}T_{ds}G_{ds}G_{ds}T_{ds}T_{ds}T_{ds}T_{ks}G_{ks}T_{k}$ | 76 | 2929 |
| 1200842 | N/A | N/A | 115908 | 115923 | CTCTTATATGGTTTTG | ${}^{m}C_{ks}T_{ks}{}^{m}C_{ks}T_{ds}T_{ds}A_{ys}T_{ds}A_{ds}T_{ds}G_{ds}G_{ds}T_{ds}T_{ds}T_{ks}T_{ks}G_{k}$ | 168 | 2842 |
| 1200843 | N/A | N/A | 115909 | 115924 | ACTCTUATATGGTTTT | $A_{ks}{}^{m}C_{ks}T_{ks}{}^{m}C_{ds}T_{ds}U_{ys}A_{ds}T_{ds}A_{ds}T_{ds}G_{ds}G_{ds}T_{ds}T_{ks}T_{ks}T_{k}$ | 46 | 2930 |
| 1200844 | N/A | N/A | 115910 | 115925 | AACTCUTATATGGTTT | $A_{ks}A_{ks}{}^{m}C_{ks}T_{ds}{}^{m}C_{ds}U_{ys}T_{ds}A_{ds}T_{ds}A_{ds}T_{ds}G_{ds}G_{ds}T_{ks}T_{ks}T_{k}$ | 132 | 2931 |
| 1200845 | N/A | N/A | 115911 | 115926 | CAACTCTTATATGGTT | ${}^{m}C_{ks}A_{ks}A_{ks}{}^{m}C_{ds}T_{ds}C_{ys}T_{ds}T_{ds}A_{ds}T_{ds}A_{ds}T_{ds}G_{ds}G_{ks}T_{ks}T_{k}$ | 100 | 2861 |
| 1200846 | N/A | N/A | 115913 | 115928 | GACAACTCTTATATGG | $G_{ks}A_{ks}{}^{m}C_{ks}A_{ds}A_{ds}C_{ys}T_{ds}{}^{m}C_{ds}T_{ds}T_{ds}A_{ds}T_{ds}A_{ds}T_{ks}G_{ks}G_{k}$ | 38 | 2862 |
| 1200847 | N/A | N/A | 117325 | 117340 | ATTGCAATCTGTCTGA | $A_{ks}T_{ks}T_{ks}G_{ds}{}^{m}C_{ds}A_{ys}A_{ds}T_{ds}{}^{m}C_{ds}T_{ds}G_{ds}T_{ds}{}^{m}C_{ds}T_{ks}G_{ks}A_{k}$ | 54 | 2843 |
| 1200848 | N/A | N/A | 117327 | 117342 | ATATTGCAATCTGTCT | $A_{ks}T_{ks}A_{ks}T_{ds}T_{ds}G_{ys}{}^{m}C_{ds}A_{ds}A_{ds}T_{ds}{}^{m}C_{ds}T_{ds}G_{ds}T_{ks}{}^{m}C_{ks}T_{k}$ | 58 | 2844 |
| 1200849 | N/A | N/A | 117328 | 117343 | AATATGCAATCTGTC | $A_{ks}A_{ks}T_{ks}A_{ds}T_{ds}U_{ys}G_{ds}{}^{m}C_{ds}A_{ds}A_{ds}T_{ds}{}^{m}C_{ds}T_{ds}G_{ks}T_{ks}{}^{m}C_{k}$ | 53 | 2932 |
| 1200850 | N/A | N/A | 117329 | 117344 | TAATAUTGCAATCTGT | $T_{ks}A_{ks}A_{ks}T_{ds}A_{ds}U_{ys}T_{ds}G_{ds}{}^{m}C_{ds}A_{ds}A_{ds}T_{ds}{}^{m}C_{ds}T_{ks}G_{ks}T_{k}$ | 83 | 2933 |
| 1200851 | N/A | N/A | 117330 | 117345 | GTAATATTGCAATCTG | $G_{ks}T_{ks}A_{ks}A_{ds}T_{ds}A_{ys}T_{ds}T_{ds}G_{ds}{}^{m}C_{ds}A_{ds}A_{ds}T_{ds}{}^{m}C_{ks}T_{ks}G_{k}$ | 25 | 1404 |
| 1200852 | N/A | N/A | 117331 | 117346 | TGTAAUATTGCAATCT | $T_{ks}G_{ks}T_{ks}A_{ds}A_{ds}U_{ys}A_{ds}T_{ds}T_{ds}G_{ds}{}^{m}C_{ds}A_{ds}A_{ks}T_{ks}{}^{m}C_{ks}T_{k}$ | 32 | 2934 |
| 1200853 | N/A | N/A | 117332 | 117347 | ATGTAATATTGCAATC | $A_{ks}T_{ks}G_{ks}T_{ds}A_{ds}A_{ys}T_{ds}A_{ds}T_{ds}T_{ds}G_{ds}{}^{m}C_{ds}A_{ds}A_{ks}T_{ks}{}^{m}C_{k}$ | 69 | 2848 |
| 1200854 | N/A | N/A | 117333 | 117348 | TATGTAATATTGCAAT | $T_{ks}A_{ks}T_{ks}G_{ds}T_{ds}A_{ys}A_{ds}T_{ds}A_{ds}T_{ds}T_{ds}G_{ds}{}^{m}C_{ds}A_{ks}A_{ks}T_{k}$ | 91 | 2849 |
| 1200855 | N/A | N/A | 117335 | 117350 | TTTATGTAATATTGCA | $T_{ks}T_{ks}T_{ks}A_{ds}T_{ds}G_{ys}T_{ds}A_{ds}A_{ds}T_{ds}A_{ds}T_{ds}T_{ds}G_{ks}{}^{m}C_{ks}A_{k}$ | 56 | 2850 |
| 1200856 | N/A | N/A | 117755 | 117770 | TGTATGTCAGAAGAGT | $T_{ks}G_{ks}T_{ks}A_{ds}T_{ds}G_{ys}T_{ds}{}^{m}C_{ds}A_{ds}G_{ds}A_{ds}A_{ds}G_{ds}A_{ks}G_{ks}T_{k}$ | 29 | 2863 |

TABLE 52-continued

Inhibition of Yap1 mRNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | CHEMSITRY NOTATION | YAP1 SEQ YAP1 (% UT) | SEQ ID NO |
|---|---|---|---|---|---|---|---|---|
| 1200857 | N/A | N/A | 117757 | 117772 | AGTGTATGTCAGAAGA | $A_ksG_{ks}T_{ks}G_{ds}T_{ds}A_{ys}T_{ds}G_{ds}T_{ds}{}^mC_{ds}A_{ds}G_{ds}A_{ds}A_{ks}G_{ks}A_k$ | 4 | 2864 |
| 1200858 | N/A | N/A | 117758 | 117773 | AAGTGUATGTCAGAAG | $A_{ks}A_{ks}G_{ks}T_{ds}G_{ds}U_{ys}A_{ds}T_{ds}G_{ds}T_{ds}{}^mC_{ds}A_{ds}G_{ds}A_{ks}A_{ks}G_k$ | 10 | 2935 |
| 1200859 | N/A | N/A | 117759 | 117774 | AAAGTGTATGTCAGAA | $A_{ks}A_{ks}A_{ks}G_{ds}T_{ds}G_{ys}T_{ds}A_{ds}T_{ds}G_{ds}T_{ds}{}^mC_{ds}A_{ds}G_{ks}A_{ks}A_k$ | 28 | 2866 |
| 1200860 | N/A | N/A | 117760 | 117775 | TAAAGUGTATGTCAGA | $T_{ks}A_{ks}A_{ks}A_{ds}G_{ds}U_{ys}G_{ds}T_{ds}A_{ds}T_{ds}G_{ds}T_{ds}{}^mC_{ds}A_{ks}G_{ks}A_k$ | 16 | 2936 |
| 1200861 | N/A | N/A | 117761 | 117776 | TTAAAGTGTATGTCAG | $T_{ks}T_{ks}A_{ks}A_{ds}A_{ds}G_{ys}T_{ds}G_{ds}T_{ds}A_{ds}T_{ds}G_{ds}T_{ds}{}^mC_{ks}A_{ks}G_k$ | 10 | 2868 |
| 1200862 | N/A | N/A | 117762 | 117777 | TTTAAAGTGTATGTCA | $T_{ks}T_{ks}T_{ks}A_{ds}A_{ds}A_{ys}G_{ds}T_{ds}G_{ds}T_{ds}A_{ds}T_{ds}G_{ds}T_{ks}{}^mC_{ks}A_k$ | 17 | 2869 |
| 1200863 | N/A | N/A | 117763 | 117778 | CTTTAAAGTGTATGTC | ${}^mC_{ks}T_{ks}T_{ks}T_{ds}A_{ds}A_{ys}A_{ds}G_{ds}T_{ds}G_{ds}T_{ds}A_{ds}T_{ds}G_{ks}T_{ks}{}^mC_k$ | 41 | 1634 |
| 1200864 | N/A | N/A | 117765 | 117780 | AACTTUAAAGTGTATG | $A_{ks}A_{ks}{}^mC_{ks}T_{ds}T_{ds}U_{ys}A_{ds}A_{ds}A_{ds}G_{ds}T_{ds}G_{ds}T_{ds}A_{ks}T_{ks}G_k$ | 84 | 2937 |
| 1200865 | N/A | N/A | 119667 | 119682 | TAAGGUTTCCCAGATT | $T_{ks}A_{ks}A_{ks}G_{ds}G_{ds}U_{ys}T_{ds}T_{ds}{}^mC_{ds}{}^mC_{ds}{}^mC_{ds}A_{ds}G_{ds}A_{ks}T_{ks}T_k$ | 54 | 2938 |
| 1200866 | N/A | N/A | 119669 | 119684 | AGTAAGGTTTCCCAGA | $A_{ks}G_{ks}T_{ks}A_{ds}A_{ds}G_{ys}G_{ds}T_{ds}T_{ds}T_{ds}{}^mC_{ds}{}^mC_{ds}{}^mC_{ds}A_{ks}G_{ks}A_k$ | 41 | 2852 |
| 1200867 | N/A | N/A | 119670 | 119685 | AAGTAAGGTTTCCCAG | $A_{ks}A_{ks}G_{ks}T_{ds}A_{ds}A_{ys}G_{ds}G_{ds}T_{ds}T_{ds}T_{ds}{}^mC_{ds}{}^mC_{ds}{}^mC_{ks}A_{ks}G_k$ | 38 | 2853 |
| 1200868 | N/A | N/A | 119671 | 119686 | TAAGTAAGGTTTCCCA | $T_{ks}A_{ks}A_{ks}G_{ds}T_{ds}A_{ys}A_{ds}G_{ds}G_{ds}T_{ds}T_{ds}T_{ds}{}^mC_{ds}{}^mC_{ks}A_k$ | 36 | 2854 |
| 1200869 | N/A | N/A | 119672 | 119687 | CTAAGUAAGGTTTCCC | ${}^mC_{ks}T_{ks}A_{ks}A_{ds}G_{ds}U_{ys}A_{ds}A_{ds}G_{ds}G_{ds}T_{ds}T_{ds}T_{ds}{}^mC_{ks}{}^mC_{ks}{}^mC_k$ | 25 | 2939 |
| 1200870 | N/A | N/A | 119673 | 119688 | ACTAAGTAAGGTTTCC | $A_{ks}{}^mC_{ks}T_{ks}A_{ds}A_{ds}G_{ys}T_{ds}A_{ds}A_{ds}G_{ds}G_{ds}T_{ds}T_{ds}T_{ks}{}^mC_{ks}{}^mC_k$ | 73 | 2855 |
| 1200871 | N/A | N/A | 119674 | 119689 | GACTAAGTAAGGTTTC | $G_{ks}A_{ks}{}^mC_{ks}T_{ds}A_{ds}A_{ys}G_{ds}T_{ds}A_{ds}A_{ds}G_{ds}G_{ds}T_{ds}T_{ks}{}^mC_k$ | 65 | 2856 |
| 1200872 | N/A | N/A | 119675 | 119690 | AGACTAAGTAAGGTTT | $A_{ks}G_{ks}A_{ks}{}^mC_{ds}T_{ds}A_{ys}A_{ds}G_{ds}T_{ds}A_{ds}A_{ds}G_{ds}G_{ds}T_{ks}T_{ks}T_k$ | 98 | 2857 |
| 1200873 | N/A | N/A | 119677 | 119692 | TTAGACTAAGTAAGGT | $T_{ks}T_{ks}A_{ks}G_{ds}A_{ds}C_{ys}T_{ds}A_{ds}A_{ds}G_{ds}T_{ds}A_{ds}A_{ds}G_{ks}G_{ks}T_k$ | 55 | 2858 |

Example 6

Dose-Dependent Inhibition of Human Yap1 in A-431 Cells by cEt Gapmers

Modified oligonucleotides described in the studies above were tested at various doses in A-431 cells. Cultured A-431 cells at a density of 5,000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to total RNA content, as measured by RIBOGREEN®. Results are presented in the tables below as percent control of the amount of Yap1 mRNA relative to untreated control cells (% UTC). IC50s were calculated using a linear regression on a log/linear plot of the data in excel.

TABLE 53

Dose-dependent inhibition of human Yap1 mRNA expression by modified oligonucleotides in A-431 cells

| | % UTC | | | | IC50 |
|---|---|---|---|---|---|
| ION No. | 148 nM | 444 nM | 1333 nM | 4000 nM | (µM) |
| 715415 | 84 | 59 | 55 | 42 | 1.8 |
| 715423 | 83 | 91 | 80 | 57 | >4.0 |
| 715433 | 87 | 72 | 65 | 40 | 2.5 |
| 715434 | 84 | 69 | 64 | 43 | 2.8 |
| 715473 | 89 | 67 | 50 | 30 | 1.3 |
| 715478 | 70 | 47 | 29 | 16 | 0.4 |
| 715479 | 98 | 80 | 77 | 64 | >4.0 |
| 715480 | 91 | 79 | 67 | 59 | >4.0 |
| 715483 | 82 | 58 | 43 | 35 | 1.1 |
| 715486 | 93 | 89 | 81 | 56 | >4.0 |
| 715487 | 87 | 56 | 48 | 29 | 1.0 |
| 715490 | 98 | 89 | 76 | 43 | 4.1 |
| 715500 | 97 | 72 | 67 | 48 | 3.6 |
| 715501 | 82 | 82 | 68 | 56 | >4.0 |
| 715508 | 78 | 70 | 67 | 43 | 3.5 |
| 715510 | 88 | 67 | 59 | 45 | 2.4 |
| 715523 | 100 | 62 | 75 | 44 | 3.2 |
| 715555 | 93 | 71 | 63 | 42 | 2.5 |
| 715577 | 87 | 76 | 73 | 45 | >4.0 |

TABLE 54

Dose-dependent inhibition of human Yap1 mRNA expression by modified oligonucleotides in A-431 cells

| ION No. | % UTC 148 nM | 444 nM | 1333 nM | 4000 nM | IC50 (µM) |
|---|---|---|---|---|---|
| 715414 | 91 | 91 | 102 | 67 | >4.0 |
| 715435 | 80 | 67 | 61 | 48 | 3.4 |
| 715471 | 82 | 103 | 105 | 79 | >4.0 |
| 715478 | 72 | 59 | 31 | 18 | 0.6 |
| 715558 | 94 | 112 | 80 | 66 | >4.0 |
| 715582 | 98 | 63 | 93 | 70 | >4.0 |
| 716370 | 81 | 79 | 69 | 49 | >4.0 |
| 716376 | 103 | 94 | 79 | 50 | >4.0 |
| 716424 | 76 | 69 | 51 | 44 | 2.0 |
| 716445 | 89 | 82 | 56 | 44 | 2.6 |
| 716454 | 91 | 71 | 54 | 48 | 2.6 |
| 716469 | 71 | 78 | 89 | 39 | >4.0 |
| 716481 | 89 | 90 | 58 | 32 | 2.0 |
| 716484 | 88 | 78 | 80 | 55 | >4.0 |
| 716493 | 95 | 97 | 86 | 72 | >4.0 |
| 716496 | 74 | 87 | 64 | 49 | >4.0 |
| 716502 | 73 | 57 | 45 | 30 | 0.8 |
| 716505 | 83 | 103 | 82 | 66 | >4.0 |
| 716577 | 109 | 93 | 79 | 60 | >4.0 |

TABLE 55

Dose-dependent inhibition of human Yap1 mRNA expression by modified oligonucleotides in A-431 cells

| ION No. | % UTC 148 nM | 444 nM | 1333 nM | 4000 nM | IC50 (µM) |
|---|---|---|---|---|---|
| 715478 | 76 | 56 | 32 | 18 | 0.6 |
| 716381 | 106 | 90 | 80 | 44 | 4.2 |
| 716387 | 94 | 94 | 80 | 67 | >4.0 |
| 716407 | 84 | 75 | 72 | 39 | 3.0 |
| 716419 | 89 | 84 | 49 | 47 | 2.5 |
| 716438 | 93 | 75 | 62 | 49 | 3.4 |
| 716455 | 95 | 70 | 49 | 25 | 1.2 |
| 716479 | 88 | 78 | 55 | 57 | >4.0 |
| 716480 | 80 | 56 | 38 | 39 | 1.0 |
| 716489 | 84 | 83 | 69 | 61 | >4.0 |
| 716500 | 88 | 96 | 79 | 46 | >4.0 |
| 716501 | 91 | 69 | 66 | 55 | >4.0 |
| 716503 | 91 | 80 | 67 | 64 | >4.0 |
| 716513 | 82 | 73 | 39 | 39 | 1.4 |
| 716524 | 103 | 92 | 96 | 62 | >4.0 |
| 716537 | 120 | 96 | 88 | 63 | >4.0 |
| 716543 | 62 | 99 | 79 | 64 | >4.0 |
| 716548 | 99 | 89 | 79 | 67 | >4.0 |
| 716554 | 87 | 90 | 76 | 50 | >4.0 |

Example 7

Dose-Dependent Inhibition of Human Yap1 in A-431 Cells by cEt Gapmers

Modified oligonucleotides described in the studies above were tested at various doses in A-431 cells. Cultured A-431 cells at a density of 10,000 cells per well were treated using free uptake with modified oligonucleotides diluted to concentrations described in the tables below. After approximately 48 hours, Yap1 mRNA levels were measured as previously described using the Human Yap1 primer-probe set RTS36584. Yap1 mRNA levels were normalized to total RNA content, as measured by RIBOGREEN®. Results are presented in the tables below as percent control of the amount of Yap1 mRNA relative to untreated control cells (% UTC). IC50s were calculated using a linear regression on a log/linear plot of the data in excel.

TABLE 56

Dose-dependent inhibition of human Yap1 mRNA expression by modified oligonucleotides in A-431 cells

| ION No. | % UTC 15.6 nM | 62.5 nM | 250.0 nM | 4000.00 nM | IC50 (µM) |
|---|---|---|---|---|---|
| 715483 | 78 | 38 | 15 | 6 | 0.05 |
| 715491 | 92 | 83 | 48 | 28 | 0.27 |
| 958356 | 84 | 79 | 39 | 21 | 0.18 |
| 958361 | 100 | 80 | 42 | 22 | 0.22 |
| 958369 | 107 | 68 | 34 | 17 | 0.17 |
| 958370 | 98 | 74 | 41 | 22 | 0.20 |
| 958371 | 89 | 57 | 27 | 11 | 0.10 |
| 958373 | 72 | 45 | 21 | 17 | 0.05 |
| 958375 | 74 | 35 | 11 | 5 | 0.04 |
| 958377 | 90 | 60 | 38 | 17 | 0.13 |
| 958403 | 94 | 63 | 30 | 12 | 0.12 |
| 958476 | 71 | 30 | 13 | 6 | 0.03 |
| 958496 | 86 | 53 | 27 | 9 | 0.09 |
| 958536 | 94 | 67 | 30 | 16 | 0.14 |
| 958596 | 69 | 38 | 14 | 7 | 0.04 |
| 958721 | 72 | 32 | 9 | 3 | 0.03 |
| 958726 | 99 | 70 | 40 | 16 | 0.17 |
| 958736 | 83 | 38 | 14 | 7 | 0.06 |
| 958796 | 91 | 62 | 32 | 15 | 0.13 |

TABLE 57

Dose-dependent inhibition of human Yap1 mRNA expression by modified oligonucleotides in A-431 cells

| ION No. | % UTC 15.6 nM | 62.5 nM | 250.0 nM | 4000.00 nM | IC50 (µM) |
|---|---|---|---|---|---|
| 715483 | 79 | 45 | 15 | 4 | 0.1 |
| 958451 | 98 | 74 | 51 | 23 | 0.2 |
| 958466 | 84 | 81 | 49 | 30 | 0.3 |
| 958481 | 86 | 62 | 28 | 14 | 0.1 |
| 958486 | 87 | 73 | 45 | 22 | 0.2 |
| 958491 | 94 | 65 | 27 | 10 | 0.1 |
| 958506 | 80 | 55 | 24 | 10 | 0.1 |
| 958526 | 118 | 83 | 40 | 17 | 0.2 |
| 958531 | 92 | 63 | 26 | 13 | 0.1 |
| 958541 | 81 | 51 | 18 | 9 | 0.1 |
| 958546 | 91 | 72 | 45 | 22 | 0.2 |
| 958551 | 95 | 73 | 34 | 14 | 0.2 |
| 958556 | 103 | 95 | 63 | 34 | 0.5 |
| 958616 | 78 | 49 | 29 | 17 | 0.1 |
| 958686 | 75 | 69 | 38 | 18 | 0.1 |
| 958731 | 85 | 64 | 39 | 19 | 0.1 |
| 958761 | 84 | 73 | 41 | 24 | 0.2 |
| 958781 | 77 | 45 | 20 | 10 | 0.1 |
| 958786 | 106 | 84 | 51 | 25 | 0.3 |

TABLE 58

Dose-dependent inhibition of human Yap1 mRNA expression by modified oligonucleotides in A-431 cells

| ION No. | % UTC 15.6 nM | 62.5 nM | 250.0 nM | 4000.00 nM | IC50 (µM) |
|---|---|---|---|---|---|
| 715483 | 84 | 44 | 15 | 5 | 0.1 |
| 958457 | 91 | 50 | 24 | 13 | 0.1 |
| 958472 | 92 | 63 | 39 | 23 | 0.2 |
| 958477 | 83 | 37 | 14 | 6 | 0.1 |
| 958497 | 82 | 35 | 11 | 3 | 0.1 |
| 958527 | 89 | 74 | 35 | 13 | 0.1 |
| 958532 | 88 | 44 | 16 | 7 | 0.1 |

TABLE 58-continued

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 958537 | 100 | 56 | 21 | 11 | 0.1 |
| 958542 | 90 | 70 | 35 | 17 | 0.1 |
| 958547 | 98 | 74 | 43 | 22 | 0.2 |
| 958567 | 99 | 80 | 44 | 16 | 0.2 |
| 958577 | 81 | 51 | 22 | 11 | 0.1 |
| 958587 | 94 | 49 | 18 | 7 | 0.1 |
| 958622 | 79 | 50 | 18 | 7 | 0.1 |
| 958727 | 90 | 42 | 25 | 8 | 0.1 |
| 958742 | 105 | 70 | 39 | 20 | 0.2 |
| 958752 | 102 | 66 | 26 | 9 | 0.1 |
| 958757 | 110 | 89 | 43 | 27 | 0.3 |
| 958807 | 92 | 65 | 30 | 10 | 0.1 |

TABLE 59

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 715483 | 83 | 44 | 16 | 4 | 0.1 |
| 958498 | 70 | 21 | 5 | 2 | 0.02 |
| 958507 | 93 | 69 | 38 | 19 | 0.2 |
| 958518 | 95 | 55 | 18 | 4 | 0.1 |
| 958533 | 99 | 61 | 27 | 12 | 0.1 |
| 958553 | 68 | 23 | 12 | 5 | 0.03 |
| 958562 | 105 | 95 | 59 | 28 | 0.4 |
| 958563 | 94 | 54 | 22 | 10 | 0.1 |
| 958572 | 83 | 77 | 31 | 22 | 0.2 |
| 958573 | 81 | 56 | 23 | 8 | 0.1 |
| 958597 | 104 | 46 | 45 | 20 | 0.2 |
| 958603 | 70 | 27 | 11 | 4 | 0.03 |
| 958623 | 100 | 62 | 29 | 10 | 0.1 |
| 958668 | 81 | 38 | 12 | 5 | 0.1 |
| 958737 | 104 | 92 | 57 | 29 | 0.4 |
| 958758 | 83 | 66 | 33 | 12 | 0.1 |
| 958763 | 98 | 60 | 22 | 8 | 0.1 |
| 958767 | 101 | 57 | 20 | 10 | 0.1 |
| 958798 | 101 | 61 | 26 | 12 | 0.1 |

TABLE 60

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 715483 | 79 | 40 | 13 | 3 | 0.1 |
| 958473 | 85 | 60 | 29 | 17 | 0.1 |
| 958508 | 65 | 64 | 32 | 13 | 0.1 |
| 958523 | 86 | 64 | 31 | 12 | 0.1 |
| 958538 | 101 | 77 | 52 | 30 | 0.3 |
| 958543 | 84 | 63 | 36 | 18 | 0.1 |
| 958554 | 70 | 34 | 11 | 4 | 0.03 |
| 958558 | 84 | 83 | 67 | 35 | 0.5 |
| 958568 | 88 | 65 | 37 | 21 | 0.1 |
| 958578 | 78 | 52 | 23 | 10 | 0.1 |
| 958588 | 93 | 73 | 46 | 27 | 0.2 |
| 958593 | 99 | 60 | 27 | 15 | 0.1 |
| 958598 | 93 | 58 | 36 | 19 | 0.1 |
| 958648 | 80 | 65 | 48 | 24 | 0.2 |
| 958658 | 90 | 88 | 59 | 29 | 0.4 |

TABLE 60-continued

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 958718 | 104 | 80 | 44 | 24 | 0.2 |
| 958753 | 72 | 48 | 20 | 11 | 0.1 |
| 958793 | 88 | 61 | 42 | 25 | 0.2 |
| 958813 | 81 | 79 | 47 | 29 | 0.2 |

TABLE 61

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 715483 | 80 | 38 | 13 | 4 | 0.1 |
| 958454 | 72 | 40 | 12 | 4 | 0.04 |
| 958474 | 63 | 37 | 18 | 11 | 0.03 |
| 958484 | 77 | 38 | 10 | 4 | 0.05 |
| 958499 | 54 | 12 | 3 | 1 | <0.01 |
| 958509 | 66 | 37 | 15 | 7 | 0.03 |
| 958529 | 103 | 64 | 27 | 11 | 0.1 |
| 958534 | 85 | 48 | 21 | 9 | 0.1 |
| 958569 | 82 | 49 | 24 | 7 | 0.1 |
| 958579 | 85 | 52 | 24 | 12 | 0.1 |
| 958589 | 75 | 50 | 19 | 8 | 0.1 |
| 958599 | 100 | 74 | 44 | 16 | 0.2 |
| 958614 | 84 | 49 | 22 | 13 | 0.1 |
| 958644 | 97 | 85 | 50 | 24 | 0.3 |
| 958659 | 91 | 68 | 28 | 9 | 0.1 |
| 958724 | 89 | 55 | 20 | 6 | 0.1 |
| 958729 | 73 | 44 | 13 | 4 | 0.05 |
| 958739 | 77 | 46 | 19 | 7 | 0.1 |
| 958799 | 88 | 53 | 25 | 10 | 0.1 |

TABLE 62

Dose-dependent inhibition of human Yap1 mRNA expression by modified oligonucleotides in A-431 cells

| ION No. | % UTC | | | | IC50 (µM) |
|---|---|---|---|---|---|
| | 15.6 nM | 62.5 nM | 250.0 nM | 4000.00 nM | |
| 715483 | 88 | 40 | 12 | 4 | 0.1 |
| 958485 | 68 | 38 | 13 | 8 | 0.04 |
| 958525 | 94 | 57 | 26 | 8 | 0.1 |
| 958544 | 65 | 77 | 40 | 17 | 0.1 |
| 958545 | 75 | 50 | 19 | 8 | 0.1 |
| 958549 | 98 | 78 | 47 | 28 | 0.3 |
| 958550 | 91 | 60 | 26 | 10 | 0.1 |
| 958555 | 99 | 73 | 34 | 13 | 0.2 |
| 958565 | 83 | 62 | 30 | 13 | 0.1 |
| 958580 | 95 | 59 | 24 | 9 | 0.1 |
| 958590 | 71 | 33 | 9 | 4 | 0.03 |
| 958594 | 91 | 70 | 42 | 20 | 0.2 |
| 958615 | 91 | 60 | 34 | 18 | 0.1 |
| 958650 | 82 | 51 | 17 | 7 | 0.1 |
| 958725 | 65 | 36 | 7 | 1 | 0.03 |
| 958730 | 88 | 48 | 19 | 7 | 0.1 |
| 958734 | 87 | 65 | 35 | 15 | 0.1 |
| 958785 | 78 | 52 | 18 | 6 | 0.1 |
| 958819 | 79 | 63 | 34 | 19 | 0.1 |

TABLE 63

Dose-dependent inhibition of human Yap1 mRNA expression by modified oligonucleotides in A-431 cells

| ION No. | % UTC 15.6 nM | 62.5 nM | 250.0 nM | 4000.00 nM | IC50 (µM) |
|---|---|---|---|---|---|
| 715483 | 87 | 45 | 15 | 4 | 0.1 |
| 715483 | 77 | 36 | 10 | 3 | 0.04 |
| 715487 | 77 | 44 | 13 | 4 | 0.1 |
| 716454 | 84 | 39 | 12 | 6 | 0.1 |
| 958490 | 81 | 54 | 26 | 13 | 0.1 |
| 958500 | 91 | 63 | 32 | 16 | 0.1 |
| 958505 | 81 | 72 | 53 | 21 | 0.2 |
| 958535 | 98 | 64 | 38 | 19 | 0.2 |
| 958540 | 62 | 28 | 14 | 8 | 0.02 |
| 958570 | 93 | 60 | 33 | 17 | 0.1 |
| 958575 | 89 | 58 | 34 | 20 | 0.1 |
| 958585 | 95 | 71 | 40 | 17 | 0.2 |
| 958595 | 83 | 57 | 37 | 16 | 0.1 |
| 958600 | 69 | 44 | 23 | 14 | 0.05 |
| 958605 | 76 | 63 | 34 | 9 | 0.1 |
| 958625 | 86 | 59 | 35 | 17 | 0.1 |
| 958735 | 116 | 69 | 37 | 23 | 0.2 |
| 958795 | 90 | 69 | 38 | 20 | 0.2 |
| 958805 | 90 | 89 | 56 | 28 | 0.3 |

Example 8

Dose-Dependent Inhibition of Human Yap1 in A-431 Cells by cEt Gapmers

Modified oligonucleotides described in the studies above were tested at various doses in A-431 cells. Cultured A-431 cells at a density of 10,000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to total RNA content, as measured by RIBOGREEN®. Results are presented in the tables below as percent control of the amount of Yap1 mRNA relative to untreated control cells (% UTC). IC50s were calculated using a linear regression on a log/linear plot of the data in excel.

TABLE 64

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (µM) |
|---|---|---|---|---|---|
| 958499 | 27 | 4 | 3 | 2 | <0.02 |
| 1074368 | 67 | 34 | 15 | 10 | 0.1 |
| 1074464 | 25 | 6 | 3 | 3 | <0.02 |
| 1074560 | 50 | 16 | 6 | 4 | <0.02 |
| 1074753 | 42 | 10 | 6 | 4 | <0.02 |
| 1075137 | 70 | 22 | 8 | 4 | 0.1 |
| 1075233 | 45 | 12 | 5 | 3 | <0.02 |
| 1075712 | 69 | 38 | 13 | 7 | 0.1 |
| 1075744 | 55 | 22 | 9 | 7 | <0.02 |
| 1075808 | 38 | 9 | 4 | 4 | <0.02 |
| 1075968 | 74 | 37 | 11 | 5 | 0.1 |
| 1076000 | 71 | 31 | 10 | 5 | 0.1 |
| 1076064 | 68 | 26 | 10 | 5 | 0.1 |
| 1076256 | 68 | 33 | 11 | 6 | 0.1 |
| 1076288 | 31 | 7 | 3 | 4 | <0.02 |
| 1076416 | 67 | 33 | 13 | 7 | 0.1 |
| 1076448 | 61 | 19 | 4 | 3 | <0.02 |
| 1076449 | 44 | 8 | 3 | 2 | <0.02 |
| 1076481 | 21 | 4 | 2 | 3 | <0.02 |

TABLE 65

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (µM) |
|---|---|---|---|---|---|
| 958499 | 24 | 4 | 2 | 2 | <0.02 |
| 1074274 | 42 | 14 | 7 | 5 | <0.02 |
| 1074593 | 50 | 20 | 9 | 8 | <0.02 |
| 1074594 | 53 | 23 | 10 | 5 | <0.02 |
| 1074595 | 67 | 21 | 8 | 4 | 0.04 |
| 1074626 | 54 | 18 | 8 | 5 | <0.02 |
| 1074627 | 17 | 5 | 3 | 3 | <0.02 |
| 1074755 | 28 | 9 | 5 | 3 | <0.02 |
| 1074817 | 50 | 22 | 13 | 11 | <0.02 |
| 1074850 | 63 | 20 | 7 | 5 | 0.04 |
| 1075041 | 62 | 31 | 11 | 7 | 0.05 |
| 1075138 | 66 | 27 | 8 | 5 | 0.05 |
| 1075457 | 52 | 21 | 8 | 6 | <0.02 |
| 1075458 | 74 | 43 | 17 | 6 | 0.1 |
| 1075778 | 56 | 29 | 10 | 5 | 0.03 |
| 1075810 | 67 | 28 | 12 | 7 | 0.1 |
| 1075842 | 27 | 7 | 3 | 3 | <0.02 |
| 1076067 | 45 | 13 | 5 | 4 | <0.02 |
| 1076386 | 61 | 30 | 11 | 5 | 0.04 |

TABLE 66

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (µM) |
|---|---|---|---|---|---|
| 958499 | 28 | 4 | 2 | 2 | <0.02 |
| 1074563 | 80 | 31 | 7 | 5 | 0.1 |
| 1074564 | 40 | 14 | 7 | 4 | <0.02 |
| 1074628 | 29 | 13 | 7 | 6 | <0.02 |
| 1074723 | 56 | 24 | 11 | 8 | <0.02 |
| 1074756 | 22 | 7 | 4 | 4 | <0.02 |
| 1074851 | 51 | 19 | 9 | 7 | <0.02 |
| 1074852 | 36 | 11 | 4 | 4 | <0.02 |
| 1075395 | 60 | 18 | 7 | 5 | <0.02 |
| 1075748 | 81 | 36 | 12 | 7 | 0.1 |
| 1075876 | 47 | 20 | 7 | 5 | <0.02 |
| 1075939 | 46 | 19 | 10 | 8 | <0.02 |
| 1076003 | 60 | 28 | 17 | 11 | 0.04 |
| 1076004 | 27 | 7 | 3 | 2 | <0.02 |
| 1076260 | 61 | 30 | 12 | 5 | 0.05 |
| 1076291 | 75 | 26 | 8 | 5 | 0.1 |
| 1076323 | 41 | 35 | 13 | 5 | <0.02 |
| 1076388 | 87 | 40 | 13 | 6 | 0.1 |
| 1076483 | 63 | 27 | 11 | 6 | 0.04 |

TABLE 67

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 23 | 4 | 2 | 2 | <0.02 |
| 1074245 | 47 | 21 | 8 | 5 | <0.02 |
| 1074565 | 47 | 20 | 9 | 6 | <0.02 |
| 1074566 | 41 | 12 | 5 | 3 | <0.02 |
| 1074597 | 35 | 15 | 8 | 7 | <0.02 |
| 1074629 | 21 | 5 | 3 | 3 | <0.02 |
| 1074630 | 57 | 23 | 10 | 6 | <0.02 |
| 1074726 | 26 | 8 | 4 | 3 | <0.02 |
| 1074758 | 74 | 23 | 8 | 5 | 0.1 |
| 1075078 | 65 | 32 | 12 | 4 | 0.1 |
| 1075749 | 46 | 22 | 7 | 4 | <0.02 |
| 1075781 | 52 | 15 | 4 | 3 | <0.02 |
| 1075813 | 57 | 31 | 11 | 5 | 0.04 |
| 1076293 | 49 | 18 | 6 | 5 | <0.02 |
| 1076326 | 53 | 20 | 6 | 3 | <0.02 |
| 1076453 | 11 | 2 | 1 | 2 | <0.02 |
| 1076486 | 84 | 45 | 16 | 6 | 0.1 |
| 1076516 | 64 | 39 | 18 | 13 | 0.1 |
| 1076549 | 53 | 24 | 10 | 6 | <0.02 |

TABLE 68

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 31 | 5 | 2 | 2 | <0.02 |
| 1074407 | 55 | 27 | 13 | 8 | <0.02 |
| 1074535 | 57 | 21 | 7 | 5 | <0.02 |
| 1074536 | 64 | 24 | 9 | 6 | 0.04 |
| 1074728 | 28 | 7 | 4 | 4 | <0.02 |
| 1074792 | 48 | 17 | 7 | 5 | <0.02 |
| 1075047 | 80 | 63 | 27 | 10 | 0.2 |
| 1075048 | 76 | 42 | 13 | 5 | 0.1 |
| 1075111 | 42 | 11 | 6 | 5 | <0.02 |
| 1075112 | 87 | 36 | 13 | 7 | 0.1 |
| 1075143 | 59 | 21 | 5 | 3 | <0.02 |
| 1075207 | 82 | 51 | 17 | 7 | 0.1 |
| 1075686 | 72 | 44 | 18 | 14 | 0.1 |
| 1075784 | 54 | 18 | 5 | 3 | <0.02 |
| 1076070 | 55 | 17 | 8 | 6 | <0.02 |
| 1076294 | 76 | 50 | 21 | 11 | 0.1 |
| 1076295 | 55 | 17 | 5 | 3 | <0.02 |
| 1076327 | 73 | 38 | 17 | 9 | 0.1 |
| 1076456 | 43 | 14 | 5 | 3 | <0.02 |

TABLE 69

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 36 | 5 | 2 | 2 | <0.02 |
| 1074250 | 67 | 35 | 15 | 9 | 0.1 |
| 1074313 | 56 | 21 | 9 | 5 | <0.02 |
| 1074409 | 60 | 30 | 13 | 7 | 0.04 |
| 1074537 | 47 | 21 | 6 | 4 | <0.02 |
| 1074762 | 74 | 32 | 14 | 8 | 0.1 |
| 1074794 | 56 | 23 | 10 | 6 | <0.02 |
| 1075081 | 76 | 50 | 22 | 9 | 0.1 |
| 1075401 | 62 | 26 | 11 | 7 | 0.04 |
| 1075465 | 75 | 35 | 14 | 9 | 0.1 |
| 1075689 | 97 | 59 | 19 | 8 | 0.2 |
| 1075785 | 29 | 7 | 3 | 3 | <0.02 |
| 1075816 | 66 | 29 | 12 | 8 | 0.1 |
| 1076330 | 57 | 31 | 9 | 4 | 0.04 |
| 1076393 | 54 | 20 | 8 | 5 | <0.02 |
| 1076458 | 88 | 52 | 23 | 10 | 0.2 |
| 1076489 | 43 | 13 | 4 | 3 | <0.02 |
| 1076490 | 36 | 9 | 4 | 3 | <0.02 |
| 1076552 | 73 | 40 | 17 | 12 | 0.1 |

TABLE 70

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 27 | 4 | 2 | 2 | <0.02 |
| 1074251 | 73 | 33 | 16 | 10 | 0.1 |
| 1074315 | 57 | 26 | 9 | 5 | 0.03 |
| 1074411 | 47 | 20 | 8 | 6 | <0.02 |
| 1074443 | 69 | 35 | 14 | 8 | 0.1 |
| 1074795 | 38 | 14 | 7 | 5 | <0.02 |
| 1075115 | 57 | 41 | 17 | 9 | 0.1 |
| 1075146 | 67 | 38 | 16 | 8 | 0.1 |
| 1075242 | 71 | 39 | 18 | 12 | 0.1 |
| 1075243 | 50 | 18 | 7 | 5 | <0.02 |
| 1075498 | 82 | 40 | 21 | 16 | 0.1 |
| 1075819 | 48 | 18 | 7 | 5 | <0.02 |
| 1076298 | 92 | 58 | 29 | 18 | 0.2 |
| 1076299 | 68 | 38 | 13 | 5 | 0.1 |
| 1076426 | 68 | 46 | 24 | 18 | 0.1 |
| 1076427 | 75 | 30 | 9 | 4 | 0.1 |
| 1076459 | 67 | 32 | 13 | 7 | 0.1 |
| 1076491 | 81 | 45 | 21 | 10 | 0.1 |
| 1076523 | 67 | 38 | 18 | 7 | 0.1 |

TABLE 71

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 29 | 5 | 2 | 2 | <0.02 |
| 1074221 | 75 | 38 | 14 | 7 | 0.1 |
| 1074413 | 50 | 19 | 6 | 3 | <0.02 |
| 1074444 | 49 | 21 | 7 | 4 | <0.02 |
| 1074508 | 62 | 30 | 14 | 8 | 0.05 |
| 1074509 | 44 | 12 | 6 | 5 | <0.02 |
| 1075052 | 40 | 10 | 4 | 4 | <0.02 |
| 1075053 | 61 | 24 | 8 | 5 | 0.04 |
| 1075084 | 103 | 72 | 37 | 14 | 0.3 |
| 1075757 | 43 | 14 | 5 | 2 | <0.02 |
| 1075916 | 73 | 34 | 14 | 8 | 0.1 |
| 1076077 | 53 | 19 | 9 | 5 | <0.02 |
| 1076396 | 64 | 22 | 5 | 3 | 0.04 |
| 1076397 | 43 | 14 | 5 | 4 | <0.02 |
| 1076460 | 79 | 53 | 25 | 12 | 0.2 |
| 1076461 | 65 | 24 | 7 | 3 | 0.04 |
| 1076524 | 71 | 30 | 12 | 7 | 0.1 |
| 1076525 | 43 | 14 | 5 | 2 | <0.02 |
| 1076556 | 72 | 46 | 19 | 11 | 0.1 |

TABLE 72

Dose-dependent inhibition of human Yap1 mRNA expression by modified oligonucleotides in A-431 cells

| ION No. | 31.3 nM | 125.0 nM | 500.0 nM | 2000.00 nM | IC50 (µM) |
|---|---|---|---|---|---|
| 958499 | 95 | 89 | 82 | 81 | >2.0 |
| 1074222 | 59 | 21 | 8 | 5 | <0.02 |
| 1074318 | 48 | 12 | 6 | 4 | <0.02 |
| 1074414 | 64 | 34 | 14 | 7 | 0.1 |
| 1074445 | 57 | 19 | 8 | 6 | <0.02 |
| 1074446 | 39 | 11 | 5 | 3 | <0.02 |
| 1074477 | 77 | 48 | 20 | 12 | 0.1 |
| 1074606 | 31 | 10 | 6 | 4 | <0.02 |
| 1074638 | 14 | 4 | 3 | 3 | <0.02 |
| 1074766 | 72 | 32 | 14 | 7 | 0.1 |
| 1074798 | 34 | 12 | 5 | 6 | <0.02 |
| 1075118 | 85 | 36 | 8 | 4 | 0.1 |
| 1075246 | 70 | 34 | 12 | 6 | 0.1 |
| 1076174 | 58 | 21 | 7 | 4 | <0.02 |
| 1076366 | 63 | 25 | 8 | 4 | 0.04 |
| 1076430 | 42 | 14 | 6 | 4 | <0.02 |
| 1076462 | 61 | 22 | 8 | 5 | 0.03 |
| 1076494 | 34 | 7 | 3 | 2 | <0.02 |
| 1076526 | 44 | 9 | 3 | 2 | <0.02 |

TABLE 73

Dose-dependent inhibition of human Yap1 mRNA expression by modified oligonucleotides in A-431 cells

| ION No. | 31.3 nM | 125.0 nM | 500.0 nM | 2000.00 nM | IC50 (µM) |
|---|---|---|---|---|---|
| 958499 | 103 | 89 | 85 | 87 | >2.0 |
| 1074351 | 69 | 33 | 13 | 7 | 0.1 |
| 1074447 | 47 | 20 | 8 | 5 | <0.02 |
| 1074448 | 54 | 13 | 4 | 3 | <0.02 |
| 1074479 | 23 | 8 | 4 | 4 | <0.02 |
| 1074480 | 33 | 9 | 5 | 3 | <0.02 |
| 1074607 | 45 | 22 | 10 | 5 | <0.02 |
| 1074639 | 46 | 18 | 7 | 5 | <0.02 |
| 1075055 | 60 | 20 | 6 | 4 | 0.03 |
| 1075088 | 37 | 9 | 4 | 2 | <0.02 |
| 1075824 | 33 | 10 | 5 | 3 | <0.02 |
| 1075855 | 65 | 30 | 12 | 8 | 0.1 |
| 1075983 | 81 | 46 | 17 | 6 | 0.1 |
| 1076015 | 70 | 37 | 15 | 9 | 0.1 |
| 1076143 | 81 | 48 | 20 | 9 | 0.1 |
| 1076367 | 31 | 10 | 4 | 3 | <0.02 |
| 1076399 | 60 | 29 | 11 | 6 | 0.04 |
| 1076464 | 36 | 10 | 3 | 2 | <0.02 |
| 1076527 | 81 | 41 | 16 | 8 | 0.1 |

TABLE 74

Dose-dependent inhibition of human Yap1 mRNA expression by modified oligonucleotides in A-431 cells

| ION No. | 31.3 nM | 125.0 nM | 500.0 nM | 2000.00 nM | IC50 (µM) |
|---|---|---|---|---|---|
| 958499 | 33 | 5 | 3 | 2 | <0.02 |
| 1074417 | 68 | 26 | 7 | 3 | 0.1 |
| 1074576 | 69 | 41 | 14 | 9 | 0.1 |
| 1074577 | 33 | 10 | 4 | 3 | <0.02 |
| 1074608 | 49 | 20 | 9 | 7 | <0.02 |
| 1074609 | 65 | 29 | 15 | 11 | 0.1 |
| 1074672 | 34 | 18 | 10 | 7 | <0.02 |
| 1074736 | 34 | 12 | 7 | 7 | <0.02 |
| 1074737 | 50 | 21 | 8 | 6 | <0.02 |
| 1074800 | 48 | 21 | 10 | 7 | <0.02 |
| 1074801 | 76 | 41 | 19 | 12 | 0.1 |
| 1075089 | 45 | 9 | 3 | 3 | <0.02 |
| 1075249 | 77 | 37 | 16 | 8 | 0.1 |
| 1075792 | 79 | 41 | 15 | 10 | 0.1 |
| 1076017 | 59 | 25 | 9 | 5 | 0.03 |
| 1076049 | 61 | 16 | 13 | 6 | <0.02 |
| 1076369 | 60 | 20 | 6 | 3 | <0.02 |
| 1076370 | 46 | 12 | 4 | 2 | <0.02 |
| 1076465 | 72 | 32 | 14 | 7 | 0.1 |

TABLE 75

Dose-dependent inhibition of human Yap1 mRNA expression by modified oligonucleotides in A-431 cells

| ION No. | 31.3 nM | 125.0 nM | 500.0 nM | 2000.00 nM | IC50 (µM) |
|---|---|---|---|---|---|
| 958499 | 27 | 5 | 2 | 2 | <0.02 |
| 1074290 | 49 | 17 | 9 | 7 | <0.02 |
| 1074418 | 55 | 26 | 9 | 4 | <0.02 |
| 1074419 | 48 | 15 | 5 | 3 | <0.02 |
| 1074420 | 38 | 8 | 3 | 2 | <0.02 |
| 1074450 | 54 | 22 | 7 | 5 | <0.02 |
| 1074451 | 63 | 26 | 8 | 4 | 0.04 |
| 1074484 | 43 | 12 | 5 | 3 | <0.02 |
| 1074578 | 66 | 30 | 18 | 11 | 0.1 |
| 1074579 | 54 | 22 | 8 | 5 | <0.02 |
| 1074610 | 57 | 20 | 10 | 7 | <0.02 |
| 1074675 | 47 | 18 | 6 | 3 | <0.02 |
| 1075155 | 51 | 15 | 6 | 4 | <0.02 |
| 1075699 | 26 | 6 | 3 | 2 | <0.02 |
| 1076114 | 34 | 11 | 6 | 5 | <0.02 |
| 1076115 | 47 | 17 | 9 | 6 | <0.02 |
| 1076466 | 43 | 18 | 8 | 6 | <0.02 |
| 1076467 | 24 | 6 | 3 | 2 | <0.02 |
| 1076530 | 53 | 26 | 11 | 7 | <0.02 |

TABLE 76

Dose-dependent inhibition of human Yap1 mRNA expression by modified oligonucleotides in A-431 cells

| ION No. | 31.3 nM | 125.0 nM | 500.0 nM | 2000.00 nM | IC50 (µM) |
|---|---|---|---|---|---|
| 958499 | 36 | 5 | 2 | 2 | <0.02 |
| 1074229 | 58 | 24 | 9 | 5 | <0.02 |
| 1074421 | 61 | 29 | 8 | 5 | 0.04 |
| 1074452 | 88 | 28 | 9 | 5 | 0.1 |
| 1074453 | 51 | 18 | 9 | 5 | <0.02 |
| 1074485 | 47 | 14 | 5 | 3 | <0.02 |
| 1074548 | 50 | 15 | 7 | 8 | <0.02 |
| 1074549 | 67 | 31 | 12 | 7 | 0.1 |
| 1074580 | 55 | 18 | 8 | 5 | <0.02 |
| 1074613 | 63 | 23 | 9 | 6 | 0.04 |
| 1074676 | 54 | 16 | 6 | 5 | <0.02 |
| 1075061 | 58 | 23 | 9 | 6 | <0.02 |
| 1075093 | 74 | 26 | 7 | 4 | 0.1 |
| 1075701 | 84 | 34 | 11 | 6 | 0.1 |
| 1075797 | 43 | 11 | 4 | 3 | <0.02 |
| 1075893 | 80 | 29 | 11 | 8 | 0.1 |
| 1076084 | 69 | 34 | 12 | 8 | 0.1 |
| 1076085 | 70 | 34 | 14 | 9 | 0.1 |
| 1076340 | 79 | 42 | 17 | 11 | 0.1 |

TABLE 77

Dose-dependent inhibition of human Yap1 mRNA expression by modified oligonucleotides in A-431 cells

| ION No. | % UTC 31.3 nM | 125.0 nM | 500.0 nM | 2000.00 nM | IC50 (μM) |
|---|---|---|---|---|---|
| 958499 | 37 | 4 | 2 | 2 | <0.02 |
| 1074230 | 62 | 30 | 12 | 8 | 0.05 |
| 1074454 | 39 | 9 | 3 | 3 | <0.02 |
| 1074486 | 55 | 26 | 10 | 6 | <0.02 |
| 1074487 | 73 | 28 | 11 | 6 | 0.1 |
| 1074678 | 73 | 37 | 16 | 10 | 0.1 |
| 1074679 | 52 | 16 | 6 | 5 | <0.02 |
| 1074775 | 26 | 5 | 2 | 2 | <0.02 |
| 1075222 | 75 | 30 | 8 | 5 | 0.1 |
| 1075766 | 56 | 21 | 11 | 8 | <0.02 |
| 1075990 | 28 | 6 | 3 | 3 | <0.02 |
| 1076022 | 63 | 28 | 8 | 5 | 0.04 |
| 1076023 | 60 | 18 | 5 | 3 | <0.02 |
| 1076119 | 82 | 35 | 12 | 6 | 0.1 |
| 1076183 | 65 | 22 | 9 | 6 | 0.04 |
| 1076406 | 51 | 20 | 9 | 7 | <0.02 |
| 1076439 | 48 | 13 | 6 | 5 | <0.02 |
| 1076471 | 64 | 29 | 9 | 5 | 0.05 |
| 1076534 | 88 | 48 | 20 | 10 | 0.2 |

Example 9

Dose-Dependent Inhibition of Human Yap1 in SNU-449 Cells by Modified Oligonucleotides Modified oligonucleotides described in the studies above were tested at various doses in SNU-449 cells. Cultured SNU-449 cells at a density of 10,000 cells per well were treated using free uptake with modified oligonucleotides diluted to concentrations described in the tables below. After approximately 48 hours, Yap1 mRNA levels were measured as previously described using the Human Yap1 primer-probe set RTS36584. Yap1 mRNA levels were normalized to total RNA content, as measured by RIBOGREEN®. Results are presented in the tables below as percent control of the amount of Yap1 mRNA relative to untreated control cells (% UTC). IC50s were calculated using a linear regression on a log/linear plot of the data in excel.

TABLE 78

Dose-dependent inhibition of human Yap1 mRNA expression by modified oligonucleotides in SNU-449 cells

| ION No. | % UTC 31.3 nM | 125.0 nM | 500.0 nM | 2000.00 nM | IC50 (μM) |
|---|---|---|---|---|---|
| 715487 | 94 | 47 | 23 | 8 | 0.2 |
| 1198371 | 85 | 66 | 46 | 21 | 0.3 |
| 1198380 | 72 | 55 | 27 | 11 | 0.1 |
| 1198382 | 77 | 56 | 36 | 18 | 0.2 |
| 1198384 | 76 | 50 | 24 | 17 | 0.1 |
| 1198397 | 70 | 53 | 28 | 14 | 0.1 |
| 1198398 | 73 | 55 | 33 | 18 | 0.2 |
| 1198406 | 70 | 57 | 31 | 16 | 0.2 |
| 1198409 | 100 | 68 | 45 | 27 | 0.4 |
| 1198412 | 73 | 54 | 33 | 15 | 0.2 |
| 1198422 | 88 | 60 | 30 | 19 | 0.2 |
| 1198423 | 58 | 35 | 15 | 6 | 0.05 |
| 1198424 | 64 | 44 | 24 | 9 | 0.1 |
| 1198438 | 62 | 28 | 7 | 2 | 0.04 |
| 1198439 | 44 | 21 | 5 | 2 | <0.03 |
| 1198440 | 55 | 23 | 6 | 2 | <0.03 |
| 1198718 | 87 | 37 | 14 | 4 | 0.1 |
| 1198719 | 67 | 30 | 9 | 3 | 0.1 |
| 1198746 | 49 | 24 | 9 | 3 | <0.03 |

TABLE 79

Dose-dependent inhibition of human Yap1 mRNA expression by modified oligonucleotides in SNU-449 cells

| ION No. | % UTC 31.3 nM | 125.0 nM | 500.0 nM | 2000.00 nM | IC50 (μM) |
|---|---|---|---|---|---|
| 715487 | 90 | 44 | 15 | 5 | 0.1 |
| 1198202 | 83 | 46 | 16 | 5 | 0.1 |
| 1198212 | 74 | 35 | 10 | 2 | 0.1 |
| 1198213 | 91 | 33 | 11 | 3 | 0.1 |
| 1198638 | 70 | 42 | 13 | 4 | 0.1 |
| 1198641 | 55 | 29 | 11 | 3 | 0.03 |
| 1198642 | 79 | 48 | 15 | 4 | 0.1 |
| 1198656 | 55 | 22 | 8 | 3 | <0.03 |
| 1198664 | 52 | 33 | 14 | 5 | <0.03 |
| 1198673 | 51 | 26 | 8 | 3 | <0.03 |
| 1198696 | 58 | 31 | 11 | 2 | 0.04 |
| 1198697 | 60 | 29 | 7 | 1 | 0.04 |
| 1198698 | 55 | 29 | 8 | 2 | 0.03 |
| 1198724 | 56 | 25 | 8 | 3 | <0.03 |
| 1198728 | 51 | 28 | 9 | 3 | <0.03 |
| 1198786 | 63 | 32 | 11 | 2 | 0.1 |
| 1198787 | 68 | 21 | 6 | 1 | 0.05 |
| 1198788 | 64 | 30 | 7 | 2 | 0.1 |
| 1198799 | 62 | 35 | 13 | 4 | 0.1 |

TABLE 80

Dose-dependent inhibition of human Yap1 mRNA expression by modified oligonucleotides in SNU-449 cells

| ION No. | % UTC 31.3 nM | 125.0 nM | 500.0 nM | 2000.00 nM | IC50 (μM) |
|---|---|---|---|---|---|
| 715487 | 98 | 56 | 25 | 10 | 0.2 |
| 958590 | 69 | 52 | 29 | 12 | 0.1 |
| 1074728 | 69 | 45 | 19 | 8 | 0.1 |
| 1097247 | 58 | 28 | 8 | 2 | 0.04 |
| 1197215 | 56 | 31 | 7 | 2 | 0.04 |
| 1197216 | 66 | 39 | 15 | 4 | 0.1 |
| 1197217 | 66 | 39 | 14 | 4 | 0.1 |
| 1198285 | 67 | 41 | 16 | 5 | 0.1 |
| 1198286 | 64 | 45 | 22 | 8 | 0.1 |
| 1198287 | 95 | 68 | 36 | 16 | 0.3 |
| 1198288 | 77 | 43 | 17 | 7 | 0.1 |
| 1198289 | 72 | 41 | 18 | 9 | 0.1 |
| 1198290 | 60 | 39 | 20 | 10 | 0.1 |
| 1198294 | 59 | 33 | 14 | 5 | 0.05 |
| 1198295 | 82 | 47 | 19 | 8 | 0.1 |
| 1198297 | 67 | 42 | 16 | 7 | 0.1 |
| 1198347 | 67 | 54 | 24 | 8 | 0.1 |
| 1198354 | 66 | 24 | 5 | 1 | 0.05 |
| 1198356 | 85 | 30 | 7 | 1 | 0.1 |

TABLE 81

Dose-dependent inhibition of human Yap1 mRNA expression by modified oligonucleotides in SNU-449 cells

| ION No. | 31.3 nM | 125.0 nM | 500.0 nM | 2000.00 nM | IC50 (μM) |
|---|---|---|---|---|---|
| 715487 | 109 | 53 | 28 | 12 | 0.3 |
| 1198352 | 58 | 29 | 10 | 3 | 0.04 |
| 1198353 | 60 | 30 | 10 | 4 | 0.04 |
| 1198355 | 63 | 34 | 10 | 4 | 0.1 |
| 1198358 | 68 | 39 | 20 | 8 | 0.1 |
| 1198365 | 59 | 38 | 15 | 5 | 0.1 |
| 1198543 | 75 | 42 | 19 | 6 | 0.1 |
| 1198546 | 70 | 42 | 18 | 6 | 0.1 |
| 1198550 | 73 | 56 | 30 | 13 | 0.2 |
| 1198552 | 72 | 46 | 23 | 9 | 0.1 |
| 1198553 | 65 | 38 | 19 | 6 | 0.1 |
| 1198554 | 72 | 46 | 22 | 8 | 0.1 |
| 1198555 | 73 | 40 | 19 | 9 | 0.1 |
| 1198557 | 81 | 52 | 26 | 11 | 0.2 |
| 1198569 | 71 | 45 | 22 | 14 | 0.1 |
| 1198570 | 58 | 33 | 16 | 9 | 0.04 |
| 1198578 | 73 | 45 | 25 | 12 | 0.1 |
| 1198610 | 69 | 29 | 7 | 2 | 0.1 |
| 1198613 | 80 | 25 | 7 | 2 | 0.1 |

TABLE 82

Dose-dependent inhibition of human Yap1 mRNA expression by modified oligonucleotides in SNU-449 cells

| ION No. | 31.3 nM | 125.0 nM | 500.0 nM | 2000.00 nM | IC50 (μM) |
|---|---|---|---|---|---|
| 715487 | 125 | 73 | 35 | 15 | 0.4 |
| 1197229 | 54 | 32 | 16 | 7 | 0.03 |
| 1197235 | 64 | 36 | 16 | 5 | 0.1 |
| 1197236 | 64 | 46 | 25 | 14 | 0.1 |
| 1197269 | 48 | 21 | 7 | 1 | <0.03 |
| 1197270 | 43 | 23 | 8 | 2 | <0.03 |
| 1197312 | 101 | 58 | 34 | 11 | 0.3 |
| 1197313 | 71 | 38 | 16 | 6 | 0.1 |
| 1198596 | 73 | 40 | 14 | 4 | 0.1 |
| 1198605 | 57 | 27 | 7 | 1 | 0.03 |
| 1198611 | 37 | 19 | 4 | 1 | <0.03 |
| 1198612 | 44 | 12 | 2 | 0 | <0.03 |
| 1198614 | 69 | 26 | 3 | 1 | 0.1 |
| 1198615 | 52 | 23 | 5 | 2 | <0.03 |
| 1198616 | 78 | 46 | 18 | 5 | 0.1 |
| 1198623 | 48 | 24 | 5 | 1 | <0.03 |
| 1198624 | 62 | 37 | 21 | 9 | 0.1 |
| 1200797 | 84 | 52 | 23 | 11 | 0.2 |
| 1200798 | 77 | 44 | 17 | 7 | 0.1 |

TABLE 83

Dose-dependent inhibition of human Yap1 mRNA expression by modified oligonucleotides in SNU-449 cells

| ION No. | 31.3 nM | 125.0 nM | 500.0 nM | 2000.00 nM | IC50 (μM) |
|---|---|---|---|---|---|
| 715487 | 136 | 70 | 35 | 10 | 0.4 |
| 958499 | 93 | 47 | 19 | 7 | 0.2 |
| 1074461 | 76 | 37 | 15 | 5 | 0.1 |
| 1197271 | 70 | 47 | 19 | 8 | 0.1 |
| 1197309 | 91 | 63 | 30 | 9 | 0.2 |
| 1200784 | 70 | 51 | 26 | 12 | 0.1 |
| 1200785 | 98 | 73 | 42 | 24 | 0.4 |
| 1200788 | 61 | 38 | 19 | 9 | 0.1 |
| 1200789 | 60 | 32 | 15 | 5 | 0.05 |
| 1200794 | 85 | 59 | 31 | 13 | 0.2 |
| 1200796 | 69 | 47 | 25 | 12 | 0.1 |
| 1200803 | 72 | 52 | 34 | 18 | 0.2 |
| 1200806 | 91 | 54 | 34 | 18 | 0.2 |
| 1200820 | 104 | 69 | 36 | 17 | 0.3 |
| 1200857 | 66 | 30 | 8 | 2 | 0.1 |
| 1200858 | 71 | 39 | 14 | 4 | 0.1 |
| 1200860 | 59 | 35 | 15 | 5 | 0.05 |
| 1200861 | 74 | 43 | 17 | 4 | 0.1 |
| 1200862 | 88 | 64 | 35 | 13 | 0.2 |

TABLE 84

Dose-dependent inhibition of human Yap1 mRNA expression by modified oligonucleotides in SNU-449 cells

| ION No. | 31.3 nM | 125.0 nM | 500.0 nM | 2000.00 nM | IC50 (μM) |
|---|---|---|---|---|---|
| 715487 | 100 | 62 | 29 | 12 | 0.3 |
| 1074462 | 90 | 38 | 13 | 3 | 0.1 |
| 1074464 | 109 | 50 | 19 | 6 | 0.2 |
| 1198804 | 71 | 48 | 19 | 5 | 0.1 |
| 1198805 | 61 | 42 | 20 | 7 | 0.1 |
| 1198814 | 63 | 25 | 6 | 3 | 0.04 |
| 1198815 | 84 | 64 | 34 | 15 | 0.2 |
| 1198818 | 68 | 33 | 15 | 5 | 0.1 |
| 1198831 | 74 | 33 | 10 | 4 | 0.1 |
| 1198832 | 77 | 53 | 23 | 13 | 0.1 |
| 1198856 | 72 | 55 | 24 | 7 | 0.1 |
| 1198857 | 78 | 44 | 13 | 4 | 0.1 |
| 1198873 | 38 | 12 | 2 | 0 | <0.03 |
| 1198874 | 36 | 8 | 1 | 0 | <0.03 |
| 1198875 | 61 | 23 | 4 | 1 | 0.04 |
| 1198895 | 62 | 37 | 16 | 9 | 0.1 |
| 1198911 | 62 | 31 | 12 | 7 | 0.05 |
| 1198917 | 81 | 37 | 12 | 6 | 0.1 |
| 1198918 | 60 | 33 | 13 | 9 | 0.05 |

TABLE 85

Dose-dependent inhibition of human Yap1 mRNA expression by modified oligonucleotides in SNU-449 cells

| ION No. | 31.3 nM | 125.0 nM | 500.0 nM | 2000.00 nM | IC50 (μM) |
|---|---|---|---|---|---|
| 715487 | 103 | 56 | 25 | 10 | 0.2 |
| 1009325 | 59 | 36 | 16 | 4 | 0.1 |
| 1009326 | 59 | 35 | 14 | 4 | 0.05 |
| 1074756 | 42 | 20 | 6 | 3 | <0.03 |
| 1074798 | 62 | 38 | 17 | 8 | 0.1 |
| 1076187 | 68 | 46 | 24 | 12 | 0.1 |
| 1076453 | 67 | 29 | 8 | 1 | 0.1 |
| 1076481 | 86 | 40 | 15 | 3 | 0.1 |
| 1197176 | 66 | 37 | 19 | 6 | 0.1 |
| 1197177 | 56 | 29 | 8 | 2 | 0.03 |
| 1197178 | 64 | 36 | 14 | 4 | 0.1 |
| 1197179 | 58 | 38 | 17 | 7 | 0.1 |
| 1197193 | 85 | 52 | 24 | 11 | 0.2 |
| 1197213 | 87 | 46 | 14 | 2 | 0.1 |
| 1197214 | 88 | 31 | 7 | 1 | 0.1 |
| 1197223 | 88 | 55 | 25 | 8 | 0.2 |
| 1198312 | 76 | 34 | 10 | 5 | 0.1 |
| 1198872 | 49 | 21 | 6 | 1 | <0.03 |
| 1198877 | 62 | 32 | 13 | 5 | 0.05 |

TABLE 86

Dose-dependent inhibition of human Yap1 mRNA expression by modified oligonucleotides in SNU-449 cells

| ION No. | % UTC | | | | IC50 (µM) |
|---|---|---|---|---|---|
| | 31.3 nM | 125.0 nM | 500.0 nM | 2000.00 nM | |
| 715487 | 92 | 53 | 22 | 12 | 0.2 |
| 1095481 | 73 | 47 | 16 | 8 | 0.1 |
| 1095593 | 73 | 44 | 27 | 10 | 0.1 |
| 1198203 | 71 | 51 | 25 | 11 | 0.1 |
| 1198211 | 72 | 37 | 23 | 12 | 0.1 |
| 1198243 | 55 | 28 | 10 | 5 | <0.03 |
| 1198267 | 78 | 44 | 15 | 3 | 0.1 |
| 1198268 | 83 | 52 | 17 | 5 | 0.1 |
| 1198457 | 82 | 56 | 31 | 12 | 0.2 |
| 1198460 | 60 | 49 | 28 | 11 | 0.1 |
| 1198466 | 68 | 44 | 18 | 6 | 0.1 |
| 1198470 | 73 | 41 | 18 | 9 | 0.1 |
| 1198484 | 80 | 45 | 24 | 12 | 0.1 |
| 1198501 | 65 | 36 | 17 | 11 | 0.1 |
| 1198524 | 50 | 32 | 9 | 3 | <0.03 |
| 1198525 | 62 | 26 | 8 | 1 | 0.04 |
| 1198526 | 61 | 30 | 8 | 2 | 0.04 |
| 1198527 | 63 | 35 | 12 | 3 | 0.1 |
| 1198905 | 75 | 43 | 21 | 6 | 0.1 |

TABLE 87

Dose-dependent inhibition of human Yap1 mRNA expression by modified oligonucleotides in SNU-449 cells

| ION No. | % UTC | | | | IC50 (µM) |
|---|---|---|---|---|---|
| | 31.3 nM | 125.0 nM | 500.0 nM | 2000.00 nM | |
| 715487 | 89 | 48 | 23 | 10 | 0.2 |
| 1198492 | 67 | 39 | 19 | 10 | 0.1 |
| 1198494 | 59 | 37 | 24 | 13 | 0.1 |
| 1198499 | 89 | 42 | 30 | 12 | 0.2 |
| 1198500 | 72 | 51 | 34 | 15 | 0.2 |
| 1198502 | 76 | 50 | 29 | 15 | 0.2 |
| 1198504 | 77 | 46 | 27 | 24 | 0.1 |
| 1198507 | 83 | 57 | 29 | 13 | 0.2 |
| 1198510 | 71 | 44 | 18 | 6 | 0.1 |
| 1198528 | 87 | 54 | 30 | 11 | 0.2 |
| 1198529 | 86 | 69 | 37 | 16 | 0.3 |
| 1198900 | 69 | 36 | 18 | 7 | 0.1 |
| 1198902 | 74 | 46 | 22 | 10 | 0.1 |
| 1198904 | 78 | 36 | 23 | 10 | 0.1 |
| 1198935 | 50 | 46 | 23 | 11 | 0.04 |
| 1198958 | 68 | 39 | 16 | 5 | 0.1 |
| 1198959 | 62 | 28 | 8 | 2 | 0.04 |
| 1198960 | 77 | 35 | 8 | 2 | 0.1 |
| 1198961 | 77 | 35 | 11 | 3 | 0.1 |

Example 10

Tolerability of Modified Oligonucleotides Targeting Human Yap1 in Balb/c Mice

Balb/c mice were treated with modified oligonucleotides selected from studies described above and evaluated for changes in the levels of various plasma chemistry markers. Treatment Groups of male Balb/c mice at 4-6 weeks of age (obtained from Taconic) were injected subcutaneously twice a week for four weeks (for a total of 8 treatments) with 50 mg/kg of modified oligonucleotides. One group of male Balb/c mice was injected with PBS. Mice were euthanized on day 26 post start of treatment (24 hours following the final administration).

Plasma Chemistry Markers

To evaluate the effect of modified oligonucleotides on liver function, plasma levels of alanine aminotransferase (ALT), aspartate aminotransferase (AST), and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 88

Plasma chemistry markers in Balb/c mice

| ION No. | ALT (U/L) | AST (U/L) | TBIL (mg/dL) |
|---|---|---|---|
| PBS | 35 | 56 | 0.18 |
| 715480 | 791 | 439 | 0.15 |
| 715484 | 116 | 110 | 0.15 |
| 715487 | 79 | 96 | 0.13 |
| 715491 | 33 | 48 | 0.11 |
| 715557 | 1755 | 2377 | 0.28 |
| 715558 | 65 | 91 | 0.16 |
| 715582 | 2460 | 2320 | 2.09 |
| 715593 | 628 | 610 | 0.11 |
| 715609 | 1120 | 2941 | 0.67 |
| 715659 | 332 | 431 | 0.23 |
| 715744 | 164 | 138 | 0.15 |
| 715763 | 522 | 316 | 0.18 |
| 715766 | 182 | 191 | 0.12 |
| 715784 | 47 | 47 | 0.13 |
| 715797 | 188 | 222 | 0.15 |
| 715859 | 306 | 133 | 0.17 |
| 715863 | 2090 | 903 | 0.54 |

Body and Organ Weights

Body weights of Balb/c mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 89

Body and organ weights

| ION No. | body weight (g) | Liver (g) | Kidney (g) | Spleen (g) |
|---|---|---|---|---|
| PBS | 22 | 1.05 | 0.37 | 0.09 |
| 715480 | 22 | 1.64 | 0.34 | 0.12 |
| 715484 | 22 | 1.47 | 0.37 | 0.13 |
| 715487 | 23 | 1.24 | 0.36 | 0.14 |
| 715491 | 22 | 1.03 | 0.32 | 0.12 |
| 715557 | 21 | 1.96 | 0.31 | 0.12 |
| 715558 | 22 | 1.33 | 0.38 | 0.12 |
| 715582 | 22 | 1.46 | 0.38 | 0.16 |
| 715593 | 19 | 1.12 | 0.30 | 0.13 |
| 715609 | 21 | 2.64 | 0.33 | 0.10 |
| 715659 | 20 | 1.21 | 0.31 | 0.11 |
| 715744 | 22 | 1.18 | 0.32 | 0.17 |
| 715763 | 23 | 1.71 | 0.36 | 0.13 |
| 715766 | 21 | 1.40 | 0.30 | 0.12 |
| 715784 | 23 | 1.15 | 0.39 | 0.12 |
| 715797 | 22 | 1.39 | 0.36 | 0.16 |
| 715859 | 22 | 1.32 | 0.36 | 0.14 |
| 715863 | 21 | 1.79 | 0.33 | 0.12 |

Example 11

Tolerability of Modified Oligonucleotides Targeting Human Yap1 in Balb/c Mice Balb/c mice were treated with modified oligonucleotides selected from studies described above and evaluated for changes in the levels of various plasma chemistry markers.

Treatment

Groups of male Balb/c mice at 4-6 weeks of age (obtained from Taconic) were injected subcutaneously twice a week for four weeks (for a total of 8 treatments) with 50 mg/kg of modified oligonucleotides. One group of male Balb/c mice was injected with PBS. Mice were euthanized on day 26 post start of treatment (24 hours following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 90

Plasma chemistry markers in Balb/c mice

| ION No. | ALT (U/L) | AST (U/L) | BUN (mg/dL) | TBIL (mg/dL) |
|---|---|---|---|---|
| PBS | 18 | 54 | 14 | 0.18 |
| 715415 | 1075 | 701 | 17 | 0.14 |
| 715473 | 3046 | 2861 | 20 | 2.77 |
| 715483 | 62 | 70 | 16 | 0.17 |
| 715487 | 59 | 81 | 16 | 0.18 |
| 716424 | 2077 | 1422 | 20 | 0.22 |
| 716454 | 39 | 60 | 14 | 0.18 |
| 716455 | 1089 | 1193 | 22 | 0.25 |
| 716480 | 2156 | 844 | 19 | 0.14 |
| 716481 | 1935 | 2248 | 21 | 0.46 |
| 716502 | 2920 | 1329 | 17 | 0.27 |
| 716513 | 325 | 229 | 17 | 0.14 |

Body and Organ Weights

Body weights of Balb/c mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 91

Body and organ weights

| ION No. | body weight (g) | Liver (g) | Kidney (g) | Spleen (g) |
|---|---|---|---|---|
| PBS | 24 | 1.09 | 0.40 | 0.11 |
| 715415 | 25 | 1.79 | 0.40 | 0.17 |
| 715473 | 20 | 1.46 | 0.31 | 0.09 |
| 715483 | 25 | 1.56 | 0.43 | 0.12 |
| 715487 | 27 | 1.46 | 0.42 | 0.15 |
| 716424 | 23 | 2.08 | 0.36 | 0.15 |
| 716454 | 25 | 1.48 | 0.42 | 0.14 |
| 716455 | 21 | 2.66 | 0.32 | 0.14 |
| 716480 | 21 | 2.58 | 0.34 | 0.10 |
| 716481 | 22 | 1.99 | 0.36 | 0.13 |
| 716502 | 23 | 2.18 | 0.42 | 0.10 |
| 716513 | 25 | 1.59 | 0.41 | 0.18 |

Example 12

Tolerability of Modified Oligonucleotides Targeting Human Yap1 in Balb/c Mice Balb/c mice were treated with modified oligonucleotides selected from studies described above and evaluated for changes in the levels of various plasma chemistry markers.

Treatment

Groups of male Balb/c mice at 6-7 weeks of age (obtained from Taconic) were injected subcutaneously twice a week for four weeks (for a total of 8 treatments) with 50 mg/kg of modified oligonucleotides. One group of male Balb/c mice was injected with PBS. Mice were euthanized on day 26 post start of treatment (24 hours following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 92

Plasma chemistry markers in Balb/c mice

| ION No. | ALT (U/L) | AST (U/L) | TBIL (mg/dL) | BUN (mg/dL) |
|---|---|---|---|---|
| PBS | 22 | 63 | 0.16 | 22 |
| 958375 | 2736 | 3013 | 0.43 | 22 |
| 958454 | 1183 | 2162 | 6.53 | 45 |
| 958498 | 1441 | 3197 | 0.74 | 12 |
| 958499 | 142 | 146 | 0.17 | 26 |
| 958509 | 1483 | 1627 | 0.31 | 26 |
| 958540 | 4127 | 3940 | 0.44 | 25 |
| 958553 | 174 | 227 | 0.20 | 29 |
| 958554 | 583 | 1051 | 0.28 | 17 |
| 958590 | 374 | 360 | 0.16 | 25 |
| 958603 | 1103 | 927 | 0.35 | 27 |
| 958721 | 57 | 114 | 0.17 | 28 |
| 958725 | 3758 | 3758 | 0.91 | 31 |
| 958729 | 4368 | 4503 | 2.15 | 30 |
| 958736 | 2439 | 1450 | 0.31 | 20 |

Body and Organ Weights

Body weights of Balb/c mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 93

Body and organ weights

| ION No. | body weight (g) | Liver (g) | Kidney (g) | Spleen (g) |
|---|---|---|---|---|
| PBS | 24 | 1.28 | 0.37 | 0.09 |
| 958375 | 23 | 2.00 | 0.39 | 0.12 |
| 958454 | 14 | 0.68 | 0.25 | 0.03 |
| 958498 | 20 | 1.51 | 0.45 | 0.19 |
| 958499 | 23 | 1.44 | 0.32 | 0.14 |
| 958509 | 20 | 1.50 | 0.27 | 0.13 |
| 958540 | 19 | 1.53 | 0.33 | 0.09 |
| 958553 | 21 | 1.01 | 0.29 | 0.11 |
| 958554 | 22 | 1.05 | 0.28 | 0.15 |
| 958590 | 25 | 1.76 | 0.40 | 0.13 |
| 958603 | 21 | 1.80 | 0.36 | 0.20 |
| 958721 | 24 | 1.45 | 0.33 | 0.12 |
| 958725 | 15 | 1.23 | 0.21 | 0.04 |
| 958729 | 15 | 1.32 | 0.24 | 0.05 |
| 958736 | 24 | 1.95 | 0.39 | 0.18 |

Example 13

Tolerability of Modified Oligonucleotides Targeting Human Yap1 in Balb/c Mice

Balb/c mice were treated with modified oligonucleotides selected from studies described above and evaluated for changes in the levels of various plasma chemistry markers.
Treatment Groups of male Balb/c mice at 4-6 weeks of age (obtained from Taconic) were injected subcutaneously twice a week for four weeks (for a total of 8 treatments) with 50 mg/kg of modified oligonucleotides. One group of male Balb/c mice was injected with PBS. Mice were euthanized on day 25 post start of treatment (24 hours following the final administration).
Plasma Chemistry Markers To evaluate the effect of modified oligonucleotides on liver function, plasma levels of blood urea nitrogen (BUN), alanine aminotransferase (ALT), aspartate aminotransferase (AST), and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 94

Plasma chemistry markers in Balb/c mice

| ION No. | ALT (U/L) | AST (U/L) | TBIL (mg/dL) | BUN (mg/dL) |
|---|---|---|---|---|
| PBS | 26* | 65* | 0.18 | 22 |
| 958371 | 249 | 199 | 0.24 | 30 |
| 958914 | 1855 | 1837 | 0.68 | 29 |
| 958933 | 63 | 122 | 0.22 | 33 |
| 958939 | 2236 | 1863 | 0.38 | 23 |
| 958941 | 772 | 500 | 0.23 | 30 |
| 958961 | 66 | 106 | 0.19 | 28 |

TABLE 94-continued

Plasma chemistry markers in Balb/c mice

| ION No. | ALT (U/L) | AST (U/L) | TBIL (mg/dL) | BUN (mg/dL) |
|---|---|---|---|---|
| 958973 | 93 | 126 | 0.20 | 22 |
| 959022 | 13242 | 8058 | 1.12 | 25 |
| 959030 | 1160 | 1328 | 0.21 | 29 |
| 959155 | 2146 | 1686 | 0.22 | 26 |
| 959167 | 1556 | 2096 | 0.56 | 24 |
| 959196 | 1169 | 785 | 0.31 | 27 |
| 959197 | 753 | 493 | 0.29 | 23 |

*Average of 3 values

Body and Organ Weights

Body weights of Balb/c mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 95

Body and organ weights

| ION No. | body weight (g) | Liver (g) | Kidney (g) | Spleen (g) |
|---|---|---|---|---|
| PBS | 25 | 1.29 | 0.39 | 0.09 |
| 958371 | 23 | 1.31 | 0.32 | 0.15 |
| 958914 | 19 | 1.22 | 0.32 | 0.12 |
| 958933 | 27 | 1.86 | 0.37 | 0.15 |
| 958939 | 24 | 1.67 | 0.40 | 0.23 |
| 958941 | 26 | 1.81 | 0.37 | 0.15 |
| 958961 | 26 | 1.47 | 0.39 | 0.15 |
| 958973 | 26 | 1.71 | 0.40 | 0.19 |
| 959022 | 19 | 1.76 | 0.34 | 0.11 |
| 959030 | 25 | 1.73 | 0.38 | 0.14 |
| 959155 | 21 | 1.53 | 0.34 | 0.25 |
| 959167 | 22 | 0.96 | 0.37 | 0.10 |
| 959196 | 23 | 1.22 | 0.34 | 0.11 |
| 959197 | 23 | 1.37 | 0.34 | 0.14 |

Example 14

Tolerability of Modified Oligonucleotides Targeting Human Yap1 in Balb/c Mice

Balb/c mice were treated with modified oligonucleotides selected from studies described above and evaluated for changes in the levels of various plasma chemistry markers.
Treatment Groups of male Balb/c mice at 5-6 weeks of age (obtained from Taconic) were injected subcutaneously twice a week for four weeks (for a total of 8 treatments) with 50 mg/kg of modified oligonucleotides. One group of male Balb/c mice was injected with PBS. Mice were euthanized on day 27 post start of treatment (24 hours following the final administration).
Plasma Chemistry Markers To evaluate the effect of modified oligonucleotides on liver function, plasma levels of blood urea nitrogen (BUN), alanine aminotransferase (ALT), aspartate aminotransferase (AST), and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 96

Plasma chemistry markers in Balb/c mice

| ION No. | ALT (U/L) | AST (U/L) | TBIL (mg/dL) | BUN (mg/dL) |
|---|---|---|---|---|
| PBS | 33 | 123 | 0.25 | 22 |
| 958497 | 46 | 151 | 0.24 | 26 |
| 958534 | 1962 | 1617 | 0.33 | 26 |
| 958589 | 35 | 66 | 0.21 | 24 |
| 958596 | 207 | 162 | 0.23 | 24 |
| 958622 | 224 | 254 | 0.24 | 23 |
| 958739 | 145 | 186 | 0.21 | 21 |

Body and Organ Weights

Body weights of Balb/c mice were measured on day 25, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 97

Body and organ weights

| ION No. | body weight (g) | Liver (g) | Kidney (g) | Spleen (g) |
|---|---|---|---|---|
| PBS | 23 | 1.14 | 0.35 | 0.08 |
| 958497 | 23 | 1.31 | 0.35 | 0.11 |
| 958534 | 22 | 1.81 | 0.32 | 0.09 |
| 958589 | 25 | 1.40 | 0.37 | 0.10 |
| 958596 | 25 | 2.11 | 0.36 | 0.13 |
| 958622 | 23 | 0.92 | 0.33 | 0.12 |
| 958739 | 24 | 1.58 | 0.36 | 0.13 |

Example 15

Tolerability of Modified Oligonucleotides Targeting Human Yap1 in CD-1 Mice

CD-1 mice were treated with modified oligonucleotides selected from studies described above and evaluated for changes in the levels of various plasma chemistry markers.

Treatment

Groups of four male CD-1 mice at 4-5 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized on day 26 post start of treatment (24 hrs following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), albumin (ALB) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 98

Plasma chemistry markers in CD-1 mice

| ION No. | ALT (U/L) | AST (U/L) | TBIL (mg/dL) | BUN (mg/dL) | ALB (g/dL) |
|---|---|---|---|---|---|
| PBS | 32 | 47 | 19 | 0.2 | 2.5 |
| 1074234 | 81 | 187 | 23 | 0.2 | 2.3 |
| 1074461 | 1563 | 865 | 22 | 0.6 | 2.2 |
| 1074554 | 32 | 49 | 22 | 0.2 | 2.5 |
| 1074557 | 32 | 65 | 23 | 0.2 | 2.3 |
| 1074587 | 163 | 131 | 25 | 0.2 | 2.4 |
| 1074588 | 38 | 67 | 22 | 0.2 | 2.3 |
| 1074622 | 34 | 59 | 20 | 0.2 | 2.5 |
| 1074655 | 1360 | 978 | 19 | 0.3 | 2.0 |
| 1074680 | 78 | 125 | 19 | 0.1 | 2.0 |
| 1075067 | 28 | 59 | 23 | 6.4 | 2.5 |
| 1075068 | 43 | 81 | 19 | 0.2 | 2.2 |
| 1075741 | 114 | 113 | 20 | 0.2 | 2.3 |
| 1075768 | 48 | 65 | 19 | 0.2 | 2.3 |
| 1075769 | 74 | 103 | 18 | 0.2 | 2.5 |
| 1075774 | 45 | 71 | 20 | 0.2 | 2.5 |
| 1075838 | 97 | 131 | 22 | 0.2 | 2.2 |
| 715483 | 79 | 125 | 21 | 0.2 | 2.2 |
| 715487 | 66 | 113 | 21 | 0.1 | 1.9 |
| 716454 | 44 | 56 | 20 | 0.2 | 2.3 |

Body and Organ Weights

Body weights of CD-1 mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 99

Body and organ weights

| ION No. | body weight (g) | Liver (g) | Kidney (g) | Spleen (g) |
|---|---|---|---|---|
| PBS | 44 | 2.51 | 0.61 | 0.12 |
| 1074234 | 37 | 2.26 | 0.55 | 0.12 |
| 1074554 | 38 | 2.09 | 0.52 | 0.11 |
| 1074557 | 38 | 1.87 | 0.61 | 0.15 |
| 1074587 | 39 | 2.33 | 0.58 | 0.16 |
| 1074588 | 40 | 2.40 | 0.69 | 0.20 |
| 1074622 | 38 | 2.16 | 0.64 | 0.21 |
| 1074655 | 39 | 3.40 | 0.69 | 0.30 |
| 1074680 | 42 | 2.52 | 0.65 | 0.24 |
| 1075067 | 40 | 2.12 | 0.65 | 0.17 |
| 1075068 | 38 | 2.15 | 0.64 | 0.20 |
| 1075741 | 39 | 2.21 | 0.62 | 0.23 |
| 1075768 | 37 | 1.86 | 0.54 | 0.13 |
| 1075769 | 35 | 1.76 | 0.47 | 0.10 |
| 1075774 | 37 | 2.23 | 0.59 | 0.14 |
| 1075838 | 41 | 2.28 | 0.57 | 0.25 |
| 715483 | 40 | 2.26 | 0.64 | 0.21 |
| 715487 | 41 | 2.24 | 0.59 | 0.21 |
| 716454 | 38 | 2.31 | 0.55 | 0.20 |

Example 16

Tolerability of Modified Oligonucleotides Targeting Human Yap1 in CD-1 Mice

CD-1 mice were treated with modified oligonucleotides selected from studies described above and evaluated for changes in the levels of various plasma chemistry markers.

Treatment

Groups of four male CD-1 mice at 4-5 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized on day 27 post start of treatment (24 hrs following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), albumin (ALB) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 100

Plasma chemistry markers in CD-1 mice

| ION No. | ALT (U/L) | AST (U/L) | TBIL (mg/dL) | BUN (mg/dL) | Albumin (g/dL) |
|---|---|---|---|---|---|
| PBS | 21 | 45 | 0.19 | 22 | 2.5 |
| 1076024 | 41 | 88 | 0.19 | 19 | 2.3 |
| 1076157 | 55 | 105 | 0.19 | 19 | 2.1 |
| 1076186 | 74 | 97 | 0.16 | 23 | 2.5 |
| 1076187 | 57 | 90 | 0.18 | 20 | 2.3 |
| 1076190 | 48 | 63 | 0.17 | 20 | 2.2 |
| 1076287 | 53 | 98 | 0.20 | 21 | 2.1 |
| 1076379 | 37 | 89 | 0.15 | 20 | 2.1 |
| 1076382 | 52 | 87 | 0.14 | 19 | 1.9 |
| 1076475 | 38 | 62 | 0.15 | 18 | 2.0 |
| 1095493 | 1623 | 1449 | 0.69 | 18 | 1.8 |

Body and Organ Weights

Body weights of CD-1 mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 101

Body and organ weights

| ION No. | body weight (g) | Liver (g) | Kidney (g) | Spleen (g) |
|---|---|---|---|---|
| PBS | 35 | 1.78 | 0.56 | 0.12 |
| 1076024 | 40 | 2.28 | 0.66 | 0.15 |
| 1076157 | 38 | 2.48 | 0.58 | 0.23 |
| 1076186 | 37 | 2.42 | 0.58 | 0.16 |
| 1076187 | 34 | 1.95 | 0.56 | 0.14 |
| 1076190 | 38 | 2.28 | 0.56 | 0.15 |
| 1076287 | 36 | 2.36 | 0.63 | 0.36 |
| 1076379 | 38 | 2.21 | 0.57 | 0.18 |
| 1076382 | 36 | 2.22 | 0.62 | 0.21 |
| 1076475 | 37 | 2.16 | 0.64 | 0.17 |
| 1095493 | 28 | 1.94 | 0.50 | 0.17 |

Example 17

Tolerability of Modified Oligonucleotides Targeting Human Yap1 in CD-1 Mice

CD-1 mice were treated with modified oligonucleotides selected from studies described above and evaluated for changes in the levels of various plasma chemistry markers.

Treatment

Groups of four male CD-1 mice at 4-5 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized on day 27 post start of treatment (24 hrs following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), albumin (ALB) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 102

Plasma chemistry markers in CD-1 mice

| ION No. | ALT (U/L) | AST (U/L) | BUN (mg/dL) | TBIL (mg/dL) |
|---|---|---|---|---|
| PBS | 22 | 100 | 24 | 0.16 |
| 1095404 | 1282 | 503 | 22 | 0.14 |
| 1095515 | 1041 | 951 | 19 | 1.12 |
| 1095632 | 92 | 126 | 26 | 0.15 |
| 1096947 | 46 | 116 | 23 | 0.17 |
| 1096450 | 1104 | 635 | 25 | 2.19 |
| 1096973 | 35 | 59 | 20 | 0.22 |
| 1097037 | 73 | 97 | 23 | 0.12 |
| 1096522 | 652 | 397 | 21 | 0.16 |
| 1075395 | 38 | 51 | 21 | 0.18 |
| 1097183 | 834 | 738 | 16 | 0.39 |
| 1097224 | 39 | 78 | 21 | 0.09 |
| 1097231 | 85 | 112 | 21 | 0.13 |

Body and Organ Weights

Body weights of CD-1 mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 103

Body and organ weights

| ION No. | body weight (g) | Liver (g) | Kidney (g) | Spleen (g) |
|---|---|---|---|---|
| PBS | 34 | 1.92 | 0.55 | 0.11 |
| 1095404 | 33 | 2.09 | 0.58 | 0.15 |
| 1095515 | 26 | 1.52 | 0.47 | 0.20 |
| 1095632 | 33 | 2.04 | 0.48 | 0.17 |
| 1096947 | 33 | 1.91 | 0.51 | 0.21 |
| 1096450 | 35 | 2.59 | 0.42 | 0.19 |
| 1096973 | 35 | 2.21 | 0.48 | 0.18 |
| 1097037 | 33 | 2.33 | 0.52 | 0.21 |
| 1096522 | 31 | 2.04 | 0.45 | 0.18 |
| 1075395 | 34 | 2.30 | 0.49 | 0.20 |
| 1097183 | 28 | 1.23 | 0.46 | 0.20 |
| 1097224 | 37 | 1.93 | 0.54 | 0.16 |
| 1097231 | 34 | 2.37 | 0.47 | 0.24 |

Example 18

Tolerability of Modified Oligonucleotides Targeting Human Yap1 in CD-1 Mice

CD-1 mice were treated with modified oligonucleotides selected from studies described above and evaluated for changes in the levels of various plasma chemistry markers.

Treatment

Groups of four male CD-1 mice at 5-6 weeks of age (obtained from Charles River) were injected subcutaneously twice a week for four weeks (for a total of 9 treatments) with 50 mg/kg of modified oligonucleotides. One group of male CD-1 mice was injected with PBS. Mice were euthanized on day 34 post start of treatment (24 hours following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), albumin (ALB) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 104

Plasma chemistry markers in CD-1 mice

| ION No. | ALT (U/L) | AST (U/L) | BUN (mg/dL) | TBIL (mg/dL) |
|---|---|---|---|---|
| PBS | 24 | 53 | 20 | 0.27 |
| 958499 | 79 | 88 | 24 | 0.18 |
| 1074755 | 88 | 104 | 22 | 0.21 |
| 1076453 | 56 | 113 | 20 | 0.24 |
| 1076481 | 71 | 121 | 23 | 0.23 |

Body and Organ Weights

Body weights of CD-1 mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 105

Body and organ weights

| ION No. | body weight (g) | Liver (g) | Kidney (g) | Spleen (g) |
|---|---|---|---|---|
| PBS | 39 | 1.84 | 0.59 | 0.17 |
| 958499 | 39 | 2.20 | 0.57 | 0.22 |
| 1074755 | 39 | 2.27 | 0.61 | 0.19 |
| 1076453 | 38 | 1.91 | 0.56 | 0.20 |
| 1076481 | 39 | 2.06 | 0.57 | 0.23 |

Example 19

Tolerability of Modified Oligonucleotides Targeting Human Yap1 in CD-1 Mice

CD-1 mice were treated with modified oligonucleotides selected from studies described above and evaluated for changes in the levels of various plasma chemistry markers.

Treatment

Groups of four male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized on day 26 post start of treatment (24 hrs following the final administration).

Plasma Chemistry Markers

To evaluate the effect of modified oligonucleotides on liver function, plasma levels of blood urea nitrogen (BUN), alanine aminotransferase (ALT), aspartate aminotransferase (AST), albumin (ALB) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 106

Plasma chemistry markers in CD-1 mice

| ION No. | ALT (U/L) | AST (U/L) | TBIL (mg/dL) | BUN (mg/dL) |
|---|---|---|---|---|
| PBS | 32 | 48 | 0.25 | 20 |
| 1198439 | 210 | 219 | 0.25 | 18 |
| 1198440 | 121 | 140 | 0.22 | 19 |
| 1198872 | 192 | 207 | 0.25 | 22 |
| 1157929 | 39 | 50 | 0.22 | 19 |
| 1157034 | 210 | 165 | 0.19 | 17 |
| 1157111 | 48 | 74 | 0.22 | 17 |

Body and Organ Weights

Body weights of CD-1 mice were measured at the end of the study, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 107

Body and organ weights

| ION No. | body weight (g) | Liver (g) | Kidney (g) | Spleen (g) |
|---|---|---|---|---|
| PBS | 36 | 2.04 | 0.59 | 0.12 |
| 1198439 | 36 | 2.03 | 0.51 | 0.25 |
| 1198440 | 35 | 1.97 | 0.46 | 0.18 |
| 1198872 | 34 | 1.84 | 0.40 | 0.16 |
| 1157929 | 34 | 1.98 | 0.43 | 0.13 |
| 1157034 | 35 | 2.43 | 0.53 | 0.17 |
| 1157111 | 36 | 2.53 | 0.50 | 0.21 |

Example 20

Tolerability of Modified Oligonucleotides Targeting Human Yap1 in Sprague-Dawley Rats Sprague-Dawley rats are a multipurpose model used for safety and efficacy evaluations. The rats were treated with Ionis modified oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow. Groups of 4 Sprague-Dawley rats each were weekly injected subcutaneously with 50 mg/kg of Ionis oligonucleotide for 6 weeks (total 7 doses). Forty-eight hours after the last dose, the rats were euthanized; and organs, urine and plasma were harvested for further analysis.

Plasma Chemistry Markers

To evaluate the effect of Ionis oligonucleotides on hepatic function, plasma levels of transaminases were measured using an automated clinical chemistry analyzer (Hitachi Olympus AU400c, Melville, N.Y.). Plasma levels of ALT (alanine transaminase) and AST (aspartate transaminase) were measured and the results are presented in the table below expressed in IU/L. Plasma levels of total bilirubin (TBIL), albumin (ALB), and blood urea nitrogen (BUN) were also measured using the same clinical chemistry analyzer and the results are also presented in the table below. Ionis modified oligonucleotides that caused changes in the levels of any markers of liver function outside the expected range for modified oligonucleotides were excluded in further studies.

TABLE 108

Plasma chemistry markers in Sprague-Dawley rats

| | Plasma clinical chemistry | | | | |
|---|---|---|---|---|---|
| ASO | ALT (U/L) | AST (U/L) | TBIL (mg/dL) | BUN (mg/dL) | ALB (g/dL) |
| PBS | 31* | 67* | 0.17* | 16 | 1.61 |
| 958499 | 61 | 109 | 0.18 | 24 | 2.78 |
| 1074755 | 57 | 97 | 0.12 | 29 | 2.99 |
| 1076187 | 54 | 113 | 0.10 | 21 | 2.91 |
| 1076453 | 47 | 77 | 0.13 | 23 | 3.14 |
| 1076481 | 50 | 91 | 0.13 | 49 | 2.74 |
| 1097224 | 31 | 51 | 0.07 | 86 | 1.61 |

*Refers to groups with only 3 data points

Kidney Function

To evaluate the effect of Ionis oligonucleotides on kidney function, urinary levels of total protein and creatinine were measured using an automated clinical chemistry analyzer (Hitachi Olympus AU400c, Melville, N.Y.). The ratios of total protein to creatinine (P/C ratio) are presented in the Table below. Ionis oligonucleotides that caused changes in the levels of the ratio outside the expected range for modified oligonucleotides were excluded in further studies.

TABLE 109

Total protein to creatinine ratio in Sprague-Dawley rats

| ION NO. | URINE P/C ratio |
|---|---|
| PBS | 1 |
| 958499 | 5 |
| 1074755 | 5 |
| 1076187 | 5 |
| 1076453 | 5 |
| 1076481 | 5 |
| 1097224 | 87 |

Body and Organ Weights

Liver, spleen and kidney weights were measured at the end of the study and are presented in the table below. Terminal body weight was measured prior to necropsy. Ionis oligonucleotides that caused any changes in organ weights outside the expected range for modified oligonucleotides were excluded from further studies.

TABLE 110

Body and Organ weights

| ION No. | body weight (g) | Liver (g) | Kidney (g) | Spleen (g) |
|---|---|---|---|---|
| PBS | 423 | 16 | 3.1 | 0.9 |
| 958499 | 333 | 14 | 3.1 | 2.8 |
| 1074755 | 357 | 16 | 3.3 | 2.1 |
| 1076187 | 344 | 17 | 3.0 | 1.7 |
| 1076453 | 371 | 16 | 3.2 | 2.1 |
| 1076481 | 367 | 14 | 2.6 | 2.1 |
| 1097224 | 316 | 13 | 4.5 | 1.4 |

Example 21

Tolerability of Modified Oligonucleotides Targeting Human Yap1 in Sprague-Dawley Rats Sprague-Dawley rats are a multipurpose model used for safety and efficacy evaluations. The rats were treated with Ionis modified oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow. Groups of 4 Sprague-Dawley rats each were weekly injected subcutaneously with 50 mg/kg of Ionis oligonucleotide for 6 weeks (total 7 doses). Forty-eight hours after the last dose, the rats were euthanized; and organs, urine and plasma were harvested for further analysis.

Plasma Chemistry Markers

To evaluate the effect of Ionis oligonucleotides on hepatic function, plasma levels of transaminases were measured using an automated clinical chemistry analyzer (Hitachi Olympus AU400c, Melville, N.Y.). Plasma levels of ALT (alanine transaminase) and AST (aspartate transaminase) were measured and the results are presented in the Table below expressed in IU/L. Plasma levels of total bilirubin (TBIL) and blood urea nitrogen (BUN) were also measured using the same clinical chemistry analyzer and the results are also presented in the Table below. Ionis modified oligonucleotides that caused changes in the levels of any markers of liver function outside the expected range for modified oligonucleotides were excluded in further studies.

TABLE 111

Plasma chemistry markers in Sprague-Dawley rats

| | Plasma clinical chemistry | | | |
|---|---|---|---|---|
| ASO | ALT (U/L) | AST (U/L) | TBIL (mg/dL) | BUN (mg/dL) |
| PBS | 64 | 98 | 0.19 | 19 |
| 1198874 | 73 | 102 | 0.16 | 22 |
| 1200857 | 183 | 318 | 4.93 | 56 |
| 1074756 | 114* | 79* | 0.10* | 0.57* |
| 1198873 | 78* | 79* | 0.17* | 24* |
| 1198439 | 54* | 94* | 0.15* | 22* |
| 1198615 | 38 | 71 | 0.13 | 21 |
| 1198440 | 58** | 108** | 0.17** | 20** |
| 1198612 | 74 | 91 | 0.12 | 31 |
| 1198312 | 132 | 108 | 0.14 | 25 |

*Refers to groups with 3 samples
**Refers to groups with 2 samples

Body and Organ Weights

Liver, spleen and kidney weights were measured at the end of the study and are presented in the table below. Terminal body weight was measured prior to necropsy. Ionis oligonucleotides that caused any changes in organ weights outside the expected range for modified oligonucleotides were excluded from further studies.

TABLE 112

Body and Organ weights

| ION No. | body weight (g) | Liver (g) | Kidney (g) | Spleen (g) |
|---|---|---|---|---|
| PBS | 453 | 17 | 3.64 | 0.91 |
| 1198874 | 372 | 20 | 3.67 | 2.61 |
| 1200857 | 307 | 19 | 6.97 | 2.55 |
| 1074756 | 349 | 21* | 4.71* | 1.99* |
| 1198873 | 408 | 19 | 3.65 | 2.42 |
| 1198439 | 319* | 17* | 3.68* | 2.28* |
| 1198615 | 369 | 16 | 3.01 | 2.35 |
| 1198440 | 373 | 18 | 3.29 | 2.78 |
| 1198612 | 345 | 17 | 3.60 | 2.33 |
| 1198312 | 365 | 19 | 4.26 | 2.19 |

*Refers to groups with 3 samples

Kidney Function

To evaluate the effect of Ionis oligonucleotides on kidney function, urinary levels of total protein and creatinine were measured using an automated clinical chemistry analyzer (Hitachi Olympus AU400c, Melville, N.Y.). The ratios of total protein to creatinine (P/C ratio) are presented in the Table below. Ionis oligonucleotides that caused changes in the levels of the ratio outside the expected range for modified oligonucleotides were excluded in further studies.

TABLE 113

Total protein to creatinine ratio in Sprague-Dawley rats

| ION NO. | URINE P/C ratio |
|---|---|
| PBS | 1 |
| 1198874 | 9 |
| 1200857 | 52 |
| 1074756 | 167 |
| 1198873 | 9 |
| 1198439 | 8* |
| 1198615 | 8 |
| 1198440 | 9 |
| 1198612 | 11 |
| 1198312 | 60 |

*Refers to groups with 3 samples

Example 22

Tolerability of Modified Oligonucleotides Targeting Human Yap1 in Sprague-Dawley Rats Sprague-Dawley rats are a multipurpose model used for safety and efficacy evaluations. The rats were treated with Ionis modified oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow. Groups of 4 Sprague-Dawley rats each were weekly injected subcutaneously with 50 mg/kg of Ionis oligonucleotide for 6 weeks (total 7 doses). Forty-eight hours after the last dose, the rats were euthanized; and organs, urine and plasma were harvested for further analysis.

Plasma Chemistry Markers

To evaluate the effect of Ionis oligonucleotides on hepatic function, plasma levels of transaminases were measured using an automated clinical chemistry analyzer (Hitachi Olympus AU400c, Melville, N.Y.). Plasma levels of ALT (alanine transaminase) and AST (aspartate transaminase) were measured and the results are presented in the Table below expressed in IU/L. Plasma levels of total bilirubin (TBIL) and blood urea nitrogen (BUN) were also measured using the same clinical chemistry analyzer and the results are also presented in the Table below. Ionis modified oligonucleotides that caused changes in the levels of any markers of liver function outside the expected range for modified oligonucleotides were excluded in further studies.

TABLE 114

Plasma chemistry markers in Sprague-Dawley rats

| | Plasma clinical chemistry | | | |
|---|---|---|---|---|
| ASO | ALT (U/L) | AST (U/L) | TBIL (mg/dL) | BUN (mg/dL) |
| PBS | 80 | 105 | 0.22 | 19 |
| 1197270 | 84 | 120 | 0.19 | 24 |
| 1198872 | 109 | 134 | 0.20 | 18 |
| 1198728 | 54 | 71 | 0.18 | 22 |
| 1198831 | 54 | 69 | 0.20 | 23 |
| 1198623 | 96 | 87 | 0.24 | 21 |
| 1198605 | 46 | 76 | 0.33 | 18 |

Kidney Function

To evaluate the effect of Ionis oligonucleotides on kidney function, urinary levels of total protein and creatinine were measured using an automated clinical chemistry analyzer (Hitachi Olympus AU400c, Melville, N.Y.). The ratios of total protein to creatinine (P/C ratio) are presented in the Table below. Ionis oligonucleotides that caused changes in the levels of the ratio outside the expected range for modified oligonucleotides were excluded in further studies.

TABLE 115

Total protein to creatinine ratio in Sprague-Dawley rats

| ION NO. | URINE P/C ratio |
|---|---|
| PBS | 1 |
| 1197270 | 14 |
| 1198872 | 8 |
| 1198728 | 7 |
| 1198831 | 17 |
| 1198623 | 5 |
| 1198605 | 28 |

Body and Organ Weights

Liver, spleen and kidney weights were measured at the end of the study and are presented in the table below. Terminal body weight was measured prior to necropsy. Ionis oligonucleotides that caused any changes in organ weights outside the expected range for modified oligonucleotides were excluded from further studies.

TABLE 116

Body and Organ weights

| ION No. | body weight (g) | Liver (g) | Kidney (g) | Spleen (g) |
|---|---|---|---|---|
| PBS | 476 | 18 | 3.4 | 0.9 |
| 1197270 | 374 | 15 | 3.6 | 2.0 |
| 1198872 | 417 | 17 | 3.4 | 1.3 |
| 1198728 | 381 | 15 | 2.9 | 1.4 |
| 1198831 | 426 | 19 | 3.3 | 2.0 |
| 1198623 | 472 | 20 | 3.6 | 1.9 |
| 1198605 | 372 | 18 | 3.6 | 2.1 |

Example 23

Measurement of Viscosity of Modified Oligonucleotides Targeting Human Yap1

The viscosity of select modified oligonucleotides from the studies described above was measured with the aim of screening out modified oligonucleotides which have a viscosity of more than 40 centipoise (cP). Modified oligonucleotides having a viscosity greater than 40 cP would have less than optimal viscosity.

Oligonucleotides (32-38 mg) were weighed into a glass vial; approximately 100 μL of water was added, and the modified oligonucleotide was dissolved into solution by heating the vial to 55° C. Part (75 μL) of the pre-heated sample was pipetted to a micro-viscometer (PAC Cambridge Viscosity Viscometer). The temperature of the micro-viscometer was set to 25° C. and the viscosity of the sample was measured. The entire 75 uL of sample was them combined with the remaining portion of the sample was diluted appropriately for UV reading at 260 nM (Cary UV instrument). Modified oligonucleotides solutions that were not optimal in their viscosity under the criterion stated above were excluded in further studies.

TABLE 117

Viscosity of modified oligonucleotides

| Compound ID | Concentration by weight (mg/mL) | Concentration by UV (mg/mL) | Viscocity (cP) |
|---|---|---|---|
| 958499 | 300 | 220.7 | 84.5 |
| 1074755 | 300 | 217.2 | 7.2 |
| 1074756 | 300 | 232.8 | 17.4 |
| 1076187 | 300 | 237.4 | 40.6 |
| 1076453 | 300 | 229.1 | 46.4 |
| 1076481 | 300 | 213.0 | 6.4 |
| 1097224 | 300 | 230.7 | 8.1 |
| 1197269 | 300 | 211.4 | 10.7 |
| 1197270 | 300 | 241.6 | 15.1 |
| 1198243 | 300 | 234.0 | 13.4 |
| 1198312 | 300 | 233.1 | 17.5 |
| 1198439 | 300 | 233.8 | 14 |
| 1198440 | 300 | 219.7 | 8.6 |
| 1198501 | 300 | 220.0 | 14.5 |
| 1198605 | 300 | 220.7 | 59.6 |
| 1198611 | 300 | 228.3 | 8.6 |
| 1198612 | 300 | 230.1 | 10.2 |
| 1198615 | 300 | 223.1 | 23 |
| 1198623 | 300 | 215.4 | 20.8 |
| 1198641 | 300 | 223.2 | 16.4 |
| 1198656 | 300 | 227.6 | 26.1 |
| 1198673 | 300 | 237.2 | 15.3 |
| 1198728 | 300 | 241.8 | 30.9 |
| 1198746 | 300 | 232.7 | 13.4 |
| 1198831 | 300 | 204.0 | 5.8 |
| 1198872 | 300 | 220.7 | 5.5 |
| 1198873 | 300 | 229.1 | 7.6 |
| 1198874 | 300 | 222.0 | 12.5 |
| 1200857 | 300 | 226.4 | 13.1 |

Example 24

Dose-Dependent Inhibition of Human Yap1 in A-431 Cells by Modified Oligonucleotides Modified oligonucleotides described in the studies above were tested at various doses in A-431 cells. Cultured A-431 cells at a density of 11,000 cells per well were treated using free uptake with modified oligonucleotides diluted to concentrations described in the tables below. After approximately 48 hours, Yap1 mRNA levels were measured as previously described using the Human Yap1 primer-probe set RTS36584. Yap1 mRNA levels were normalized to GAPDH content, as measured by primer probe set RTS104 (forward sequence GAAGGTGAAGGTCGGAGTC, designated herein as SEQ ID NO.: 17; reverse sequence GAAGATGGTGATGGGATTTC, designated herein as SEQ ID NO.: 18; probe sequence CAAGCTTCCCGTTCTCAGCC, designated herein as SEQ ID NO.: 19). Results are presented in the tables below as percent control of the amount of Yap1 mRNA relative to untreated control cells (% UTC). IC50s were calculated using a linear regression on a log/linear plot of the data in excel.

TABLE 118

Dose-dependent inhibition of human Yap1 mRNA expression by modified oligonucleotides in A-431 cells

| ION No. | % UTC | | | | | IC50 (µM) |
|---|---|---|---|---|---|---|
| | 0.002 µM | 0.008 µM | 0.04 µM | 0.2 µM | 1 µM | |
| 958499 | 1 | 3 | 28 | 91 | 117 | 0.03 |
| 1076453 | 0 | 1 | 23 | 74 | 89 | 0.01 |
| 1197270 | 0 | 2 | 26 | 80 | 99 | 0.02 |
| 1198439 | 0 | 1 | 11 | 65 | 93 | 0.02 |
| 1198440 | 0 | 1 | 14 | 69 | 96 | 0.02 |
| 1198605 | 0 | 2 | 26 | 57 | 96 | 0.02 |
| 1198623 | 2 | 5 | 28 | 72 | 96 | 0.01 |
| 1198728 | 1 | 4 | 27 | 85 | 87 | 0.02 |
| 1198831 | 2 | 6 | 28 | 72 | 83 | 0.01 |
| 1198872 | 1 | 3 | 19 | 70 | 94 | 0.01 |

Example 25

Activity of Modified Oligonucleotides Targeting Human Yap1 in SCC25 Cells

Modified oligonucleotides described in the studies above were tested at various doses in squamous cell carcinoma cell SCC25. A control oligonucleotide 792169 (a 3-10-3 cET gapmer with a full phosphorothioate backbone, CGCCGATAAGGTACAC, designated herein as SEQ ID No.: 2940; is not complementary to any known human gene) was also tested.

RNA Analysis

Cultured SCC25 cells at a density of 5,000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002 (forward sequence CGGACTATGACTTAGTTGCGTTACA, designated herein as SEQ ID NO.: 20; reverse sequence GCCATGCCAATCTCATCTTGT, designated herein as SEQ ID NO.: 21; probe sequence CCTTTCTTGACAAAACCTAACTTGCGCAGA, designated herein as SEQ ID NO.: 22). Results are presented in the tables below as percent control of the amount of Yap1 mRNA relative to untreated control cells (% UTC).

TABLE 119

Dose-dependent inhibition of human Yap1 mRNA expression by modified oligonucleotides in SCC25 cells

| ION No. | % UTC | | | |
|---|---|---|---|---|
| | 0.04 µM | 0.2 µM | 1 µM | 5 µM |
| 792169 | 96 | 89 | 93 | 98 |
| 958499 | 47 | 22 | 10 | 4 |
| 1076453 | 59 | 21 | 7 | 3 |
| 1197270 | 48 | 24 | 12 | 7 |
| 1198439 | 35 | 12 | 5 | 3 |
| 1198440 | 39 | 14 | 5 | 3 |
| 1198605 | 48 | 23 | 10 | 5 |
| 1198623 | 61 | 31 | 15 | 10 |
| 1198728 | 71 | 31 | 15 | 7 |
| 1198831 | 63 | 36 | 16 | 14 |
| 1198872 | 54 | 22 | 9 | 7 |

Cell Proliferation Assay

Cultured SCC25 cells at a density of 1,000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 120

Antiproliferative effect of modified oligonucleotides in SCC25 cells

| ION No. | % UTC | | | |
|---|---|---|---|---|
| | 0.04 µM | 0.2 µM | 1 µM | 5 µM |
| 792169 | 103 | 104 | 100 | 88 |
| 958499 | 76 | 42 | 25 | 14 |
| 1076453 | 81 | 40 | 23 | 15 |
| 1197270 | 75 | 40 | 22 | 14 |
| 1198439 | 62 | 30 | 22 | 16 |
| 1198440 | 73 | 33 | 22 | 16 |
| 1198605 | 77 | 39 | 23 | 13 |
| 1198623 | 84 | 55 | 36 | 29 |
| 1198728 | 88 | 61 | 30 | 20 |
| 1198831 | 88 | 54 | 25 | 21 |
| 1198872 | 82 | 37 | 22 | 18 |

Example 26

Dose Dependent Inhibition of Human Yap1 by Modified Oligonucleotides in a Human Hepatocellular Carcinoma SNU449 Xenograft Tumor Model A SNU449 hepatocellular carcinoma xenograft tumor model was used to evaluate activity of modified oligonucleotides targeted to human Yap1. Ten million SNU449 cells in 30% matrigel were implanted subcutaneously into the flanks of female NOD Cg-Prkdcscid Il2rgtm1Wjl/SzJ (NSG) mice (from Jackson Laboratory) at 4-6 weeks of age. When tumors reached an average volume of 100 mm³, approximately two weeks post-implantation, groups of four mice each were administered at 50 mg/kg twice weekly with modified oligonucleotides for five days. Tumors were collected and tested for Yap1 mRNA knockdown by RT-qPCR. Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated animals (% control).

TABLE 121

Inhibition of human Yap1 mRNA expression by modified oligonucleotides in SNU449 xenografts

| ION No. | % control |
|---|---|
| PBS | 100 |
| 958499 | 54 |
| 1074755 | 70 |
| 1076453 | 56 |
| 1197269 | 57 |
| 1197270 | 54 |
| 1198439 | 51 |
| 1198440 | 51 |
| 1198501 | 54 |
| 1198605 | 55 |

TABLE 121-continued

Inhibition of human Yap1 mRNA expression by modified oligonucleotides in SNU449 xenografts

| ION No. | % control |
|---|---|
| 1198615 | 62 |
| 1198623 | 60 |
| 1198641 | 68 |
| 1198673 | 52 |
| 1198728 | 64 |
| 1198831 | 67 |
| 1198872 | 52 |
| 715487 | 61 |

Example 27

Dose Dependent Inhibition of Human Yap1 by Modified Oligonucleotides in a Human Epidermoid Carcinoma A-431 Xenograft Tumor Model An epidermoid carcinoma A-431 xenograft tumor model was used to evaluate activity of modified oligonucleotides targeted to human Yap1. Five million A-431 cells in 30% matrigel were implanted subcutaneously into the flanks of female NCr-Foxn1nu mice (from Taconic) at 4-6 weeks of age. When tumors reached an average volume of 40 $mm^3$, approximately two weeks post-implantation, groups of four mice each were administered at either 25 mg/kg or 50 mg/kg daily with modified oligonucleotides for four days (5 doses). Tumors were collected 6-8 hours post final dose and tested for Yap1 mRNA knockdown by RT-qPCR. Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated animals (% control).

TABLE 122

Dose-dependent inhibition of human Yap1 mRNA expression by modified oligonucleotides in A-431 xenografts

| ION No. | % control | |
|---|---|---|
|  | 25 mpk | 50 mpk |
| PBS | 100 | 100 |
| 958499 | 49 | 29 |
| 1076453 | 55 | 25 |
| 1197270 | 57 | 38 |
| 1198439 | 37 | 19 |
| 1198440 | 32 | 21 |
| 1198605 | 32 | 30 |
| 1198623 | 43 | 36 |
| 1198728 | 47 | 39 |
| 1198831 | 47 | 37 |
| 1198872 | 34 | 26 |
| 715487 | 61 | 57 |

Example 28

Dose Dependent Inhibition of Human Yap1 by Modified Oligonucleotides in a Human Squamous Cell Carcinoma CAL27 Xenograft Tumor Model A squamous cell carcinoma CAL27 xenograft tumor model was used to evaluate activity of modified oligonucleotides targeted to human Yap1. Five million CAL27 cells in 30% matrigel were implanted subcutaneously into the flanks of female CrTac:NCr-Foxn1nu mice (from Taconic) at 4-6 weeks of age. Groups of four mice each were administered with either 15 mg/kg or 30 mg/kg of modified oligonucleotides daily for five days after tumor size had reached ~100 $mm^3$ (about 3 weeks post implantation). Tumors were collected and tested for Yap1 mRNA knockdown by RT-qPCR. Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated untreated control cells (% UTC).

TABLE 123

Dose-dependent inhibition of human Yap1 mRNA expression by modified oligonucleotides in CAL27 xenografts

| ION No. | % UTC | |
|---|---|---|
|  | 15 mg/kg | 30 mg/kg |
| PBS | 100 | 100 |
| 958499 | 68 | 53 |
| 1076453 | 69 | 46 |
| 1197270 | 55 | 38 |
| 1198439 | 66 | 38 |
| 1198440 | 67 | 41 |
| 1198605 | 65 | 48 |
| 1198623 | 52 | 44 |
| 1198728 | 77 | 56 |
| 1198831 | 70 | 48 |
| 1198872 | 55 | 38 |

Example 29

Activity of Modified Oligonucleotides Targeting Human Yap1 in a Human Squamous Cell Carcinoma CAL33 Xenograft Tumor Model A xenograft tumor model was used to evaluate activity of modified oligonucleotides targeted to human Yap1. One million CAL33 cells in 30% matrigel were implanted subcutaneously into the flanks of female CrTac:NCr-Foxn1nu (Taconic) mice. When tumors reached an average volume of 100 $mm^3$, approximately two weeks post-implantation, groups of eight mice were administered at 50 mg/kg twice weekly with modified oligonucleotides for two weeks. ION 792169 was administered as a control.

Tumor samples were collected for measurement of Yap1 mRNA levels by RT-qPCR. Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated animals (% control).

Tumor volume was measured at the indicated days in the table below. Tumor weight was determined at end of study. Mice were sacrificed when tumors from PBS-treated mice reached 2,000 mm3.

TABLE 124

Yap1 mRNA levels in tumors

| ION No. | % control |
|---|---|
| PBS | 102 |
| 792169 | 74 |
| 1198728 | 40 |
| 1198440 | 12 |

TABLE 125

Tumor volume (mm³)

Days post-implantation

| ION Number | 10 | 13 | 17 | 21 | 24 | 27 | 31 | 34 | 38 | 40 | 44 |
|---|---|---|---|---|---|---|---|---|---|---|---|
| | | | | Average Tumor Volume(mm³) | | | | | | | |
| PBS | 144 | 254 | 382 | 666 | 855 | 974 | 1180 | 1342 | 1458 | 1472 | 1377 |
| 792169 | 123 | 262 | 367 | 531 | 774 | 805 | 962 | 1057 | 1171 | 1160 | 1069 |
| 1198728 | 113 | 253 | 423 | 621 | 835 | 988 | 1123 | 1233 | 1239 | 1277 | 1277 |
| 1198440 | 115 | 279 | 376 | 574 | 651 | 818 | 888 | 857 | 770 | 746 | 834 |

TABLE 126

Tumor weight (g)

| ION No. | Average Tumor weight (g) |
|---|---|
| PBS | 1.02 |
| 792169 | 0.85 |
| 1198728 | 0.88 |
| 1198440 | 0.36 |

Example 30

Activity of Modified Oligonucleotides Targeting Human Yap1 in a Human Hepatocellular Carcinoma SNU449 Xenograft Tumor Model Modified oligonucleotides described in the studies above were tested in a hepatocellular carcinoma SNU449 xenograft tumor model. A control oligonucleotide 792169 was also tested.

Five million SNU449 cells in 30% matrigel were implanted subcutaneously into the fatpads of female NOD.Cg-Prkdcscid Il2rgtm1Wjl/SzJ mice (from Jackson Laboratory) at 4-6 weeks of age. 43 days post implantation (when tumors had reached approximately 100 mm³ in size), groups of eight mice each were administered with 50 mg/kg modified oligonucleotide daily for 10 days (loading dose), following which they were administered with 50 mg/kg modified oligonucleotide four times a week for one week, following which they were dosed with 50 mg/kg modified oligonucleotide thrice weekly until the end of the study. Animals were sacrificed and tumors were collected on day 119 post implantation. Yap1 mRNA knockdown in tumors was measured by RT-qPCR as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated animals (% control).

Tumor volumes were also measured at the indicated days in the table below

TABLE 127

Yap1 mRNA levels in tumors

| Ion No. | % control |
|---|---|
| PBS | 100 |
| 792169 | 90 |
| 1198440 | 34 |

TABLE 128

Tumor volume (mm³)

| Days Post Tumor Implantation | Average Tumor Volume (mm³) | | |
|---|---|---|---|
| | PBS | 792169 | 1198440 |
| 43 | 111 | 111 | 111 |
| 46 | 175 | 162 | 152 |
| 50 | 208 | 180 | 168 |
| 53 | 252 | 247 | 201 |
| 57 | 292 | 280 | 242 |
| 60 | 362 | 317 | 263 |
| 64 | 396 | 397 | 338 |
| 67 | 438 | 466 | 376 |
| 71 | 463 | 519 | 373 |
| 75 | 570 | 559 | 401 |
| 78 | 597 | 634 | 429 |
| 81 | 657 | 681 | 514 |
| 85 | 760 | 785 | 606 |
| 88 | 786 | 889 | 613 |
| 92 | 955 | 1170 | 690 |
| 94 | 1048 | 1215 | 773 |
| 98 | 1114 | 1355 | 804 |
| 101 | 1175 | 1417 | 818 |
| 105 | 1252 | 1509 | 894 |
| 108 | 1284 | 1571 | 921 |
| 119 | 1431 | 1697* | 978 |

*Average of 7 samples

Example 31

Activity of Modified Oligonucleotides Targeting Human Yap1 in NCI H747 Cells Modified oligonucleotides described in the studies above were tested at various doses in colorectal adenocarcinoma cell line NCI H747. A control oligonucleotide 792169 was also tested.

RNA Analysis

Cultured NCI H747 cells at a density of 10,000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 129

Dose-dependent inhibition of human Yap1 mRNA expression by modified oligonucleotides in NCI H747 cells

| ION No. | % UTC | | | |
|---|---|---|---|---|
| | 0.04 μM | 0.2 μM | 1 μM | 5 μM |
| 792169 | 94 | 83 | 87 | 100 |
| 715487 | 83 | 70 | 49 | 30 |
| 1198440 | 73 | 53 | 21 | 9 |

Cell Proliferation Assay

Cultured NCI H747 cells at a density of 3000 cells/well were treated using free uptake with modified oligonucleotides diluted to concentrations described in the tables below. After 7 days, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 130

Antiproliferative effect of modified oligonucleotides in NCI H747 cells

| ION No. | % UTC | | | |
|---|---|---|---|---|
| | 0.04 μM | 0.2 μM | 1 μM | 5 μM |
| 792169 | 89 | 97 | 91 | 80 |
| 715487 | 91 | 86 | 65 | 42 |
| 1198440 | 87 | 66 | 36 | 18 |

Example 32

Activity of Modified Oligonucleotides Targeting Human Yap1 in NCI H292 Cells

Modified oligonucleotides described in the studies above were tested at various doses in mucoepidermoid pulmonary carcinoma cell line NCI 1-1292. A control oligonucleotide 792169 was also tested.

RNA Analysis

Cultured NCI H292 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 131

Dose-dependent inhibition of human Yap1 mRNA expression by modified oligonucleotides in NCI H292 cells

| ION No. | % UTC | | | |
|---|---|---|---|---|
| | 0.04 μM | 0.2 μM | 1 μM | 5 μM |
| 792169 | 98 | 112 | 111 | 106 |
| 715487 | 104 | 83 | 40 | 12 |
| 1198440 | 89 | 53 | 18 | 5 |

Cell Proliferation Assay

Cultured NCI H292 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 132

Antiproliferative effect of modified oligonucleotides in NCI H292 cells

| ION No. | % UTC | | | |
|---|---|---|---|---|
| | 0.04 μM | 0.2 μM | 1 μM | 5 μM |
| 792169 | 98 | 97 | 99 | 92 |
| 715487 | 87 | 90 | 69 | 20 |
| 1198440 | 100 | 83 | 30 | 15 |

Example 33

Activity of Modified Oligonucleotides Targeting Human Yap1 in BICR56 Cells

Modified oligonucleotides described in the studies above were tested at various doses in squamous cell carcinoma adherent keratinocyte cell line BICR56. A control oligonucleotide 792169 was also tested.

RNA Analysis

Cultured BICR56 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 133

Dose-dependent inhibition of human Yap1 mRNA expression by modified oligonucleotides in BICR56 cells

| ION No. | % UTC | | | |
|---|---|---|---|---|
| | 0.04 μM | 0.2 μM | 1 μM | 5 μM |
| 792169 | 99 | 92 | 85 | 97 |
| 715487 | 68 | 28 | 16 | 11 |
| 1198440 | 40 | 10 | 7 | 7 |

Cell Proliferation Assay

Cultured BICR56 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 134

Antiproliferative effect of modified oligonucleotides in BICR56 cells

| ION No. | % UTC | | | |
|---|---|---|---|---|
| | 0.04 µM | 0.2 µM | 1 µM | 5 µM |
| 792169 | 106 | 100 | 92 | 87 |
| 715487 | 70 | 26 | 9 | 4 |
| 1198440 | 28 | 10 | 6 | 4 |

Example 34

Effect of Modified Oligonucleotides Targeting Human Yap1 in Cynomolgus Monkeys

Cynomolgus monkeys were treated with Ionis modified oligonucleotides selected from studies described in the Examples above. Modified oligonucleotide tolerability was evaluated.

Treatment

Prior to the study, the monkeys were kept in quarantine during which the animals were observed daily for general health. The monkeys were 2-4 years old and weighed 2-4 kg. Eleven groups of 4 randomly assigned male cynomolgus monkeys each were injected subcutaneously with Ionis oligonucleotide or saline in a clock-wise rotation between four different sites on the back. Following loading doses on days 1, 3, 5 and 7, the monkeys were dosed once per week (on days 14, 21, 28, 35, and 42) with 35 mg/kg of Ionis oligonucleotide. A control group of 4 cynomolgus monkeys was injected with 0.9% saline in a similar manner and served as the control group.

During the study period, the monkeys were observed twice daily for signs of illness or distress. Any animal experiencing more than momentary or slight pain or distress due to the treatment, injury or illness was treated by the veterinary staff with approved analgesics or agents to relieve the pain after consultation with the Study Director. Any animal in poor health or in a possible moribund condition was identified for further monitoring and possible euthanasia. Scheduled euthanasia of the animals was conducted on day 86 approximately 48 hours after the last dose by exsanguination while under deep anesthesia. The protocols described in the Example were approved by the Institutional Animal Care and Use Committee (IACUC).

Body and Organ Weight Measurements

To evaluate the effect of Ionis oligonucleotides on the overall health of the animals, body and organ weights were measured. Terminal body weight was measured prior to necropsy. Organ weights were measured as well, and all weight measurements are presented in the Table below. The results indicate that effect of treatment with modified oligonucleotides on body and organ weights was within the expected range for modified oligonucleotides. Specifically, treatment with ION 1198440 was well tolerated in terms of the body and organ weights of the monkeys.

TABLE 135

Body and Organ weights (g)

| ION No. | Terminal Body Weight | Heart | kidney | spleen | Liver with gallbladder |
|---|---|---|---|---|---|
| Saline | 2855 | 11 | 14 | 3 | 60 |
| 958499 | 2894 | 10 | 15 | 4 | 68 |
| 1076453 | 2955 | 11 | 16 | 5 | 72 |
| 1197270 | 2852 | 10 | 17 | 4 | 73 |
| 1198439 | 2959 | 10 | 15 | 3 | 67 |
| 1198440 | 2919 | 11 | 15 | 3 | 65 |
| 1198605 | 2968 | 11 | 15 | 4 | 67 |
| 1198623 | 2790 | 9 | 13 | 3 | 62 |
| 1198728 | 2722 | 10 | 15 | 5 | 65 |
| 1198831 | 2788 | 11 | 14 | 4 | 65 |
| 1198872 | 3126 | 12 | 15 | 4 | 63 |

Kidney and Liver Function

To evaluate the effect of Ionis oligonucleotides on hepatic and kidney function, blood samples were collected from all the study groups on day 44. The monkeys were fasted overnight prior to blood collection. Blood was collected in tubes without anticoagulant for serum separation. The tubes were kept at room temperature for a minimum of 90 minutes and then centrifuged at 3000 rpm for 10 minutes to obtain serum. Levels of various liver function markers were measured using a Toshiba 200FR NEO chemistry analyzer (Toshiba Co., Japan). Plasma levels of glucose (GLU), blood urea nitrogen (BUN), creatinine (CREA), total protein (TP), albumin (ALB), globulin (GLO), albumin/globulin (A/G) ratio calculated, alanine aminotransferase (ALT), aspartate aminotransferase (AST), total bilirubin (TBIL), gamma-glutamyltransferase (GGT), alkaline phosphatase (ALP), triglyceride (TG), high density lipoprotein (HDL), and low density lipoprotein (LDL) were measured and the results are presented in the table below. The results indicate that modified oligonucleotides had no effect on liver function outside the expected range for modified oligonucleotides. Specifically, treatment with ION 1198440 was well tolerated in terms of the liver function in monkeys.

TABLE 136

Liver/Kidney function markers in cynomolgus monkey plasma

| ION NO. | ALT (IU/L) | AST (IU/L) | TBIL (mg/dL) | GGT (IU/L) | ALP (IU/L) | TG (mg/dL) | HDL (mg/dL) | LDL (mg/dL) |
|---|---|---|---|---|---|---|---|---|
| Saline | 60 | 50 | 0.3 | 91 | 1539 | 34 | 96 | 68 |
| 958499 | 67 | 73 | 0.2 | 67 | 1449 | 41 | 89 | 46 |
| 1076453 | 53 | 76 | 0.2 | 78 | 1173 | 29 | 98 | 66 |
| 1197270 | 84 | 78 | 0.2 | 75 | 1215 | 31 | 102 | 48 |
| 1198439 | 40 | 65 | 0.2 | 63 | 1298 | 28 | 82 | 59 |

TABLE 136-continued

Liver/Kidney function markers in cynomolgus monkey plasma

| ION NO. | ALT (IU/L) | AST (IU/L) | TBIL (mg/dL) | GGT (IU/L) | ALP (IU/L) | TG (mg/dL) | HDL (mg/dL) | LDL (mg/dL) |
|---|---|---|---|---|---|---|---|---|
| 1198440 | 45 | 75 | 0.2 | 80 | 1412 | 30 | 104 | 54 |
| 1198605 | 40 | 58 | 0.2 | 85 | 1445 | 25 | 115 | 57 |
| 1198623 | 50 | 47 | 0.2 | 59 | 916 | 34 | 87 | 50 |
| 1198728 | 58 | 92 | 0.3 | 59 | 1165 | 24 | 95 | 57 |
| 1198831 | 48 | 63 | 0.3 | 65 | 1096 | 22 | 108 | 63 |
| 1198872 | 48 | 94 | 0.3 | 79 | 1098 | 19 | 114 | 60 |

TABLE 137

Liver/Kidney function markers in cynomolgus monkey plasma

| ION NO. | GLU (mg/dL) | BUN (mg/dL) | CREA (mg/dL) | TP (g/dL) | ALB (g/dL) | GLO (g/dL) | A/G ratio |
|---|---|---|---|---|---|---|---|
| Saline | 84 | 25 | 1.0 | 7.2 | 4.2 | 3.0 | 1.4 |
| 958499 | 83 | 24 | 0.9 | 7.2 | 4.0 | 3.2 | 1.3 |
| 1076453 | 89 | 27 | 0.9 | 7.0 | 3.9 | 3.1 | 1.3 |
| 1197270 | 115 | 27 | 0.9 | 6.8 | 3.7 | 3.1 | 1.2 |
| 1198439 | 115 | 24 | 0.9 | 6.8 | 4.0 | 2.8 | 1.4 |
| 1198440 | 91 | 26 | 0.9 | 7.0 | 4.1 | 2.9 | 1.4 |
| 1198605 | 69 | 22 | 0.8 | 6.7 | 4.0 | 2.7 | 1.5 |
| 1198623 | 70 | 26 | 0.8 | 7.2 | 4.2 | 3.0 | 1.4 |
| 1198728 | 95 | 26 | 0.9 | 7.3 | 4.1 | 3.2 | 1.3 |
| 1198831 | 73 | 26 | 0.7 | 6.7 | 3.9 | 2.8 | 1.4 |
| 1198872 | 80 | 27 | 0.9 | 7.1 | 4.0 | 3.1 | 1.3 |

Pro-Inflammatory Proteins Analysis

To evaluate any inflammatory effect of Ionis oligonucleotides in cynomolgus monkeys, blood samples were taken for analysis. The monkeys were fasted overnight prior to blood collection. On day 42 (pre-dose and 24 hours post-dose), approximately 0.8 mL of blood was collected from each animal and put into tubes without anticoagulant for serum separation. The tubes were kept at room temperature for a minimum of 90 min and then centrifuged at 3,000 rpm for 10 min at room temperature to obtain serum. Complement C3 were measured using a Toshiba 120 FR NEO chemistry analyzer (Toshiba Co., Japan). The results indicate that treatment with ION 1198440 did not cause any inflammation in monkeys. Another marker of inflammation, C-Reactive Protein (CRP) was tested together with the clinical chemistry parameters tested for liver function above.

TABLE 138

Pro-inflammatory protein analysis in cynomolgus monkeys

| | Complement C3 (mg/dL) | | |
|---|---|---|---|
| ION No. | Day 42 (pre-dose) | day 42 (24 hr post-dose) | CRP (mg/L) day 44 |
| Saline | 117 | 106 | 4.1 |
| 958499 | 112 | 89 | 9.9 |
| 1076453 | 101 | 88 | 1.5 |
| 1197270 | 103 | 86 | 9.8 |
| 1198439 | 99 | 94 | 2.9 |
| 1198440 | 95 | 88 | 4.8 |
| 1198605 | 105 | 95 | 4.2 |
| 1198623 | 105 | 101 | 2.0 |
| 1198728 | 93 | 90 | 4.0 |
| 1198831 | 81 | 81 | 1.1 |
| 1198872 | 103 | 96 | 1.1 |

Hematology

To evaluate any effect of Ionis oligonucleotides in cynomolgus monkeys on hematologic parameters, blood samples of approximately 0.5 mL of blood was collected from each of the available study animals on day 44. The samples were collected in tubes containing $K_2$-EDTA. Samples were analyzed for red blood cell (RBC) count, Hemoglobin (HGB), Hematocrit (HCT), Mean corpuscular volume (MCV), mean corpuscular hemoglobin (MCH), mean corpuscular hemoglobin concentration (MCHC), RBC Distribution Width (RCDW), reticulocyte count (Retic), platelet count (PLT), mean platelet volume (MPV), white blood cells (WBC) count, individual white blood cell counts, such as that of monocytes (MON), neutrophils (NEU), lymphocytes (LYM), eosinophils (EOS), basophils (BAS), and large unstained cells (LUC) using an ADVIA2120i hematology analyzer (Siemens, USA).

The data indicate the oligonucleotides did not cause any changes in hematologic parameters outside the expected range for modified oligonucleotides at this dose. Specifically, treatment with ION 1198440 was well tolerated in terms of the hematologic parameters of the monkeys.

TABLE 139

Blood cell counts in cynomolgus monkeys

| ION NO. | RBC (×10^6/μL) | HGB (g/dL) | HCT (%) | MCV (fL) | MCH (pg) | MCHC (g/dL) | RCDW (%) | Retic (%) | PLT (10^3/μL) |
|---|---|---|---|---|---|---|---|---|---|
| Saline | 5.8 | 13 | 46 | 79 | 23 | 29 | 13 | 1.2 | 334 |
| 958499 | 5.6 | 12 | 43 | 77 | 22 | 29 | 12 | 1.5 | 399 |
| 1076453 | 5.5 | 13 | 43 | 79 | 23 | 29 | 15 | 1.2 | 358 |
| 1197270 | 5.6 | 12 | 44 | 79 | 22 | 28 | 12 | 1.1 | 452 |
| 1198439 | 6.0 | 14 | 48 | 79 | 22 | 28 | 12 | 1.2 | 367 |
| 1198440 | 5.9 | 14 | 47 | 80 | 23 | 29 | 12 | 1.2 | 420 |
| 1198605 | 6.1 | 13 | 46 | 75 | 22 | 29 | 13 | 1.1 | 385 |
| 1198623 | 5.9 | 14 | 46 | 78 | 23 | 30 | 13 | 1.0 | 376 |
| 1198728 | 5.9 | 14 | 47 | 80 | 23 | 29 | 12 | 1.3 | 428 |
| 1198831 | 5.6 | 13 | 43 | 76 | 23 | 30 | 12 | 1.0 | 377 |
| 1198872 | 5.7 | 13 | 44 | 78 | 23 | 30 | 12 | 1.2 | 400 |

TABLE 140

Blood cell counts in cynomolgus monkeys

| ION NO. | WBC (×10^3/μL) | NEU (%) | LYM (%) | MON (%) | EOS (%) | BAS (%) | LUC (%) | MPV (fL) |
|---|---|---|---|---|---|---|---|---|
| ine | 9.2 | 41 | 55 | 3.2 | 1.0 | 0.3 | 0.5 | 8.2 |
| 958499 | 12.0 | 49 | 44 | 3.5 | 1.1 | 0.4 | 1.2 | 7.6 |
| 1076453 | 10.0 | 39 | 54 | 3.9 | 1.1 | 0.4 | 1.2 | 8.4 |
| 1197270 | 10.6 | 38 | 54 | 3.5 | 2.7 | 0.4 | 1.2 | 7.1 |
| 1198439 | 10.3 | 27 | 68 | 2.9 | 1.5 | 0.3 | 0.6 | 7.6 |
| 1198440 | 10.9 | 28 | 65 | 3.2 | 2.8 | 0.4 | 0.7 | 7.5 |
| 1198605 | 10.5 | 44 | 51 | 2.8 | 0.8 | 0.4 | 0.5 | 8.1 |
| 1198623 | 11.7 | 43 | 53 | 2.0 | 0.8 | 0.4 | 0.7 | 7.8 |
| 1198728 | 10.7 | 29 | 64 | 2.9 | 2.2 | 0.5 | 0.9 | 8.0 |
| 1198831 | 7.6 | 44 | 50 | 3.3 | 2.0 | 0.3 | 0.8 | 7.3 |
| 1198872 | 10.4 | 64 | 32 | 2.2 | 0.6 | 0.3 | 0.5 | 7.1 |

Coagulation

To evaluate effect of Ionis modified oligonucleotides on coagulation in cynomolgus monkeys, blood samples of approximately 0.9 mL were collected from each of the available study animals on day 44. The samples were collected in tubes containing 3.2% sodium citrate. Coagulation parameters tested include Activated partial thromboplastin time (APTT), prothrombin time (PT) and Figrinogen (FIB).

The data indicate the modified oligonucleotides did not cause any changes in coagulation parameters outside the expected range for modified oligonucleotides at this dose. Specifically, treatment with ION 1198440 was well tolerated in terms of the coagulation parameters of the monkeys.

TABLE 141

Coagulation Parameters in cynomolgus monkeys

| ION No. | PT (sec) | FIB (mg/dL) | APTT (sec) |
|---|---|---|---|
| Saline | 9 | 229 | 18 |
| 958499 | 9 | 275 | 18 |
| 1076453 | 9 | 234 | 20 |
| 1197270 | 10 | 257 | 17 |
| 1198439 | 10 | 246 | 19 |
| 1198440 | 10 | 260 | 20 |
| 1198605 | 9 | 236 | 23 |
| 1198623 | 10 | 229 | 17 |
| 1198728 | 9 | 242 | 18 |
| 1198831 | 10 | 209 | 18 |
| 1198872 | 10 | 206 | 21 |

Urine Analysis

Food was removed overnight the day before fresh urine collection, but water was supplied. Fresh urine samples for urinalysis and urine chemistry were collected from all animals using a clean cage pan on wet ice (first in the morning) on day 44. Urinalysis/Urine Chemistry parameters creatinine (UCRE), microprotein (UTP), urine microalbumin (UALB), and protein/creatinine (P/C) ratio were measured using a Toshiba 120FR automated chemistry analyzer (Toshiba Co., Japan). Specifically, treatment with ION 1198440 was well tolerated in terms urine chemistry markers.

TABLE 142

Urinalysis and Urine Chemistry Markers

| ION NO. | UTP (mg/dL) | UALB (mg/dL) | UCRE (mg/dL) | P/C ratio |
|---|---|---|---|---|
| Saline | 13 | 0.5 | 69 | 0.3 |
| 958499 | 16 | 0.1 | 60 | 0.3 |
| 1076453 | 14 | 0.1 | 50 | 0.3 |
| 1197270 | 18 | 1.3 | 56 | 0.3 |
| 1198439 | 15 | 0.1 | 68 | 0.2 |
| 1198440 | 13 | 0.2 | 53 | 0.3 |
| 1198605 | 12 | 0.4 | 69 | 0.2 |
| 1198623 | 10 | 0.2 | 44 | 0.2 |
| 1198728 | 16 | 0.3 | 70 | 0.2 |
| 1198831 | 13 | 0.1 | 46 | 0.3 |
| 1198872 | 14 | 0.3 | 111 | 0.2 |

Example 35

Activity of Modified Oligonucleotides Targeting Human Yap1 in BICR-22 Cells

Modified oligonucleotides described in the studies above were tested at various doses in tongue squamous carcinoma (lymph node metastasis) cell line BICR-22. A control oligonucleotide 792169, described herein above, was also tested.

RNA Analysis

Cultured BICR-22 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 144

Dose-dependent inhibition of human Yap1 mRNA expression by modified oligonucleotides in BICR-22 cells

| ION No. | % UTC | | | |
|---|---|---|---|---|
| | 0.04 µM | 0.2 µM | 1 µM | 5 µM |
| 792169 | 99 | 98 | 98 | 98 |
| 715487 | 82 | 45 | 23 | 13 |
| 1198440 | 44 | 14 | 4 | 4 |

Cell Proliferation Assay

Cultured BICR-22 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 145

Antiproliferative effect of modified oligonucleotides in BICR-22 cells

| ION No. | % UTC | | | |
|---|---|---|---|---|
| | 0.04 µM | 0.2 µM | 1 µM | 5 µM |
| 792169 | 97 | 95 | 82 | 65 |
| 715487 | 70 | 56 | 28 | 22 |
| 1198440 | 55 | 37 | 29 | 19 |

Example 36

Activity of Modified Oligonucleotides Targeting Human Yap1 in CAL33 Cells

Modified oligonucleotides described in the studies above were tested at various doses in tongue squamous cell carcinoma line CAL33. A control oligonucleotide 792169, described herein above, was also tested.

RNA Analysis

Cultured CAL33 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 146

Dose-dependent inhibition of human Yap1 mRNA expression by modified oligonucleotides in CAL33 cells

| ION No. | % UTC | | | |
|---|---|---|---|---|
| | 0.04 µM | 0.2 µM | 1 µM | 5 µM |
| 792169 | 106 | 106 | 91 | 85 |
| 715487 | 81 | 41 | 12 | 6 |
| 1198440 | 43 | 14 | 5 | 5 |

Cell Proliferation Assay

Cultured CAL33 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 147

Antiproliferative effect of modified oligonucleotides in CAL33 cells

| ION No. | % UTC | | | |
|---|---|---|---|---|
| | 0.04 µM | 0.2 µM | 1 µM | 5 µM |
| 792169 | 92 | 93 | 81 | 67 |
| 715487 | 89 | 79 | 61 | 37 |
| 1198440 | 84 | 67 | 58 | 44 |

Example 37

Activity of Modified Oligonucleotides Targeting Human Yap1 in CAL27 Cells

Modified oligonucleotides described in the studies above were tested at various doses in tongue squamous cell carcinoma line CAL27. A control oligonucleotide 792169, described herein above, was also tested.

RNA Analysis

Cultured CAL27 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 148

Dose-dependent inhibition of human Yap1 mRNA expression by modified oligonucleotides in CAL27 cells

| ION No. | % UTC | | | |
|---|---|---|---|---|
| | 0.08 µM | 0.4 µM | 2 µM | 10 µM |
| 792169 | 95 | 90 | 97 | 88 |
| 715487 | 35 | 23 | 5 | 3 |
| 1198440 | 23 | 6 | 4 | 4 |

Cell Proliferation Assay

Cultured CAL27 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 149

Antiproliferative effect of modified oligonucleotides in CAL27 cells

| ION No. | % UTC | | | |
|---|---|---|---|---|
| | 0.08 µM | 0.4 µM | 2 µM | 10 µM |
| 792169 | 96 | 102 | 103 | 90 |
| 715487 | 95 | 85 | 67 | 33 |
| 1198440 | 86 | 85 | 83 | 51 |

Example 38

Activity of Modified Oligonucleotides Targeting Human Yap1 in Detroit-562 Cells

Modified oligonucleotides described in the studies above were tested at various doses in pharynx carcinoma cell line Detroit-562. A control oligonucleotide 792169, described herein above, was also tested.

RNA Analysis

Cultured Detroit-562 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 150

Dose-dependent inhibition of human Yap1 mRNA expression by modified oligonucleotides in Detroit-562 cells

| ION No. | % UTC | | | |
|---|---|---|---|---|
| | 0.04 µM | 0.2 µM | 1 µM | 5 µM |
| 792169 | 102 | 102 | 94 | 99 |
| 715487 | 77 | 29 | 10 | 5 |
| 1198440 | 32 | 8 | 3 | 2 |

Cell Proliferation Assay

Cultured Detroit-562 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 151

Antiproliferative effect of modified oligonucleotides in Detroit-562 cells

| ION No. | % UTC | | | |
|---|---|---|---|---|
| | 0.04 µM | 0.2 µM | 1 µM | 5 µM |
| 792169 | 99 | 106 | 100 | 79 |
| 715487 | 92 | 84 | 71 | 52 |
| 1198440 | 84 | 67 | 59 | 45 |

Example 39

Activity of Modified Oligonucleotides Targeting Human Yap1 in SCC-4 Cells

Modified oligonucleotides described in the studies above were tested at various doses in tongue squamous cell carcinoma cell line SCC 4. A control oligonucleotide 792169, described herein above, was also tested.

RNA Analysis

Cultured SCC-4 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 152

Dose-dependent inhibition of human Yap1 mRNA expression by modified oligonucleotides in SCC-4 cells

| ION No. | % UTC | | | |
|---|---|---|---|---|
| | 0.04 µM | 0.2 µM | 1 µM | 5 µM |
| 792169 | 92 | 106 | 105 | 104 |
| 715487 | 81 | 46 | 23 | 13 |
| 1198440 | 63 | 27 | 11 | 5 |

Cell Proliferation Assay

Cultured SCC-4 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 153

Antiproliferative effect of modified oligonucleotides in SCC-4 cells

| ION No. | % UTC | | | |
|---|---|---|---|---|
| | 0.04 µM | 0.2 µM | 1 µM | 5 µM |
| 792169 | 125 | 169 | 142 | 136 |
| 715487 | 158 | 121 | 106 | 69 |
| 1198440 | 82 | 60 | 21 | 11 |

Example 40

Activity of Modified Oligonucleotides Targeting Human Yap1 in SCC-9 Cells

Modified oligonucleotides described in the studies above were tested at various doses in tongue squamous cell carcinoma cell line SCC-9. A control oligonucleotide 792169, described herein above, was also tested.

RNA Analysis

Cultured SCC-9 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 154

Dose-dependent inhibition of human Yap 1 mRNA expression by modified oligonucleotides in SCC-9 cells

| | % UTC | | | |
|---|---|---|---|---|
| ION No. | 0.04 µM | 0.2 µM | 1 µM | 5 µM |
| 792169 | 86 | 94 | 96 | 101 |
| 715487 | 74 | 44 | 21 | 11 |
| 1198440 | 53 | 18 | 6 | 2 |

Cell Proliferation Assay

Cultured SCC-9 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 155

Antiproliferative effect of modified oligonucleotides in SCC-9 cells

| | % UTC | | | |
|---|---|---|---|---|
| ION No. | 0.04 µM | 0.2 µM | 1 µM | 5 µM |
| 792169 | 104 | 111 | 102 | 94 |
| 715487 | 97 | 73 | 51 | 34 |
| 1198440 | 88 | 46 | 35 | 31 |

Example 41

Activity of Modified Oligonucleotides Targeting Human Yap1 in SCC-15 Cells

Modified oligonucleotides described in the studies above were tested at various doses in tongue squamous cell carcinoma cell line SCC-15. A control oligonucleotide 792169, described herein above, was also tested.

RNA Analysis

Cultured SCC-15 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 156

Dose-dependent inhibition of human Yap1 mRNA expression by modified oligonucleotides in SCC-15 cells

| | % UTC | | | |
|---|---|---|---|---|
| ION No. | 0.04 µM | 0.2 µM | 1 µM | 5 µM |
| 792169 | 91 | 100 | 102 | 105 |
| 715487 | 69 | 33 | 12 | 5 |
| 1198440 | 39 | 10 | 4 | 2 |

Cell Proliferation Assay

Cultured SCC-15 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 157

Antiproliferative effect of modified oligonucleotides in SCC-15 cells

| | % UTC | | | |
|---|---|---|---|---|
| ION No. | 0.04 µM | 0.2 µM | 1 µM | 5 µM |
| 792169 | 93 | 92 | 89 | 71 |
| 715487 | 87 | 66 | 47 | 28 |
| 1198440 | 72 | 54 | 42 | 32 |

Example 42

Activity of Modified Oligonucleotides Targeting Human Yap1 in SCC-25 Cells

Modified oligonucleotides described in the studies above were tested at various doses in tongue squamous cell carcinoma cell line SCC-25. A control oligonucleotide 792169, described herein above, was also tested.

RNA Analysis

Cultured SCC-25 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 158

Dose-dependent inhibition of human Yap1 mRNA expression by modified oligonucleotides in SCC-25 cells

| | % UTC | | | |
|---|---|---|---|---|
| ION No. | 0.08 µM | 0.4 µM | 2 µM | 10 µM |
| 792169 | 87 | 87 | 89 | 86 |
| 715487 | 70 | 32 | 16 | 11 |
| 1198440 | 32 | 12 | 8 | 7 |

Cell Proliferation Assay

Cultured SCC-25 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 159

Antiproliferative effect of modified oligonucleotides in SCC-25 cells

| ION No. | % UTC | | | |
|---|---|---|---|---|
| | 0.08 μM | 0.4 μM | 2 μM | 10 μM |
| 792169 | 97 | 101 | 96 | 92 |
| 715487 | 82 | 48 | 25 | 15 |
| 1198440 | 56 | 27 | 20 | 16 |

Example 43

Activity of Modified Oligonucleotides Targeting Human Yap1 in SNU-899 Cells

Modified oligonucleotides described in the studies above were tested at various doses in laryngeal squamous cell carcinoma cell line SNU-899. A control oligonucleotide 792169, described herein above, was also tested.

RNA Analysis

Cultured SNU-899 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 160

Dose-dependent inhibition of human Yap1 mRNA expression by modified oligonucleotides in SNU-899 cells

| ION No. | % UTC | | | |
|---|---|---|---|---|
| | 0.04 μM | 0.2 μM | 1 μM | 5 μM |
| 792169 | 106 | 106 | 111 | 102 |
| 715487 | 62 | 26 | 9 | 4 |
| 1198440 | 35 | 12 | 3 | 2 |

Cell Proliferation Assay

Cultured SNU-899 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 161

Antiproliferative effect of modified oligonucleotides in SNU-899 cells

| ION No. | % UTC | | | |
|---|---|---|---|---|
| | 0.04 μM | 0.2 μM | 1 μM | 5 μM |
| 792169 | 90 | 94 | 96 | 86 |
| 715487 | 82 | 78 | 71 | 62 |
| 1198440 | 82 | 75 | 69 | 66 |

Example 44

Activity of Modified Oligonucleotides Targeting Human Yap1 in SNU-1066 Cells

Modified oligonucleotides described in the studies above were tested at various doses in laryngeal squamous cell carcinoma line SNU-1066. A control oligonucleotide 792169, described herein above, was also tested.

RNA Analysis

Cultured SNU-1066 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 162

Dose-dependent inhibition of human Yap1 mRNA expression by modified oligonucleotides in SNU-1066 cells

| ION No. | % UTC | | | |
|---|---|---|---|---|
| | 0.04 μM | 0.2 μM | 1 μM | 5 μM |
| 792169 | 91 | 94 | 93 | 98 |
| 715487 | 77 | 49 | 22 | 7 |
| 1198440 | 70 | 28 | 7 | 2 |

Cell Proliferation Assay

Cultured SNU-1066 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 163

Antiproliferative effect of modified oligonucleotides in SNU-1066 cells

| ION No. | % UTC | | | |
|---|---|---|---|---|
| | 0.04 μM | 0.2 μM | 1 μM | 5 μM |
| 792169 | 100 | 104 | 102 | 96 |
| 715487 | 97 | 86 | 72 | 47 |
| 1198440 | 89 | 66 | 58 | 43 |

Example 45

Activity of Modified Oligonucleotides Targeting Human Yap1 in SNU-1076 Cells Modified oligonucleotides described in the studies above were tested at various doses in upper aerodigestive tract/laryngeal squamous cell carcinoma line SNU-1076. A control oligonucleotide 792169, described herein above, was also tested.

RNA Analysis

Cultured SNU-1076 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 164

Dose-dependent inhibition of human Yap1 mRNA expression by modified oligonucleotides in SNU-1076 cells

| | % UTC | | | |
|---|---|---|---|---|
| ION No. | 0.04 µM | 0.2 µM | 1 µM | 5 µM |
| 792169 | 89 | 98 | 102 | 107 |
| 715487 | 89 | 67 | 31 | 11 |
| 1198440 | 83 | 43 | 11 | 3 |

Cell Proliferation Assay

Cultured SNU-1076 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 165

Antiproliferative effect of modified oligonucleotides in SNU-1076 cells

| | % UTC | | | |
|---|---|---|---|---|
| ION No. | 0.04 µM | 0.2 µM | 1 µM | 5 µM |
| 792169 | 97 | 104 | 106 | 108 |
| 715487 | 91 | 90 | 86 | 79 |
| 1198440 | 99 | 87 | 81 | 81 |

Example 46

Activity of Modified Oligonucleotides Targeting Human Yap1 in SNU-1214 Cells Modified oligonucleotides described in the studies above were tested at various doses in laryngeal squamous cell carcinoma cell line SNU-12 4. A control oligonucleotide 792169, described herein above, was also tested.

RNA Analysis

Cultured SNU-1214 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 166

Dose-dependent inhibition of human Yap1 mRNA expression by modified oligonucleotides in SNU-1214 cells

| | % UTC | | | |
|---|---|---|---|---|
| ION No. | 0.04 µM | 0.2 µM | 1 µM | 5 µM |
| 792169 | 97 | 104 | 106 | 109 |
| 715487 | 71 | 36 | 16 | 9 |
| 1198440 | 40 | 11 | 4 | 3 |

Cell Proliferation Assay

Cultured SNU-1214 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 167

Antiproliferative effect of modified oligonucleotides in SNU-1214 cells

| | % UTC | | | |
|---|---|---|---|---|
| ION No. | 0.04 µM | 0.2 µM | 1 µM | 5 µM |
| 792169 | 105 | 90 | 96 | 72 |
| 715487 | 93 | 69 | 52 | 38 |
| 1198440 | 84 | 72 | 53 | 49 |

Example 47

Activity of Modified Oligonucleotides Targeting Human Yap1 in UPCI:SCC090 Cells Modified oligonucleotides described in the studies above were tested at various doses in tongue squamous cell carcinoma cell line UPCI:SCC090. A control oligonucleotide 792169, described herein above, was also tested.

RNA Analysis

Cultured UPCI:SCC090 cells at a density of 5000 cells per well were treated using free uptake with modified oligonucleotides diluted to concentrations described in the tables below. After approximately 48 hours, Yap1 mRNA levels were measured as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to untreated control cells (% UTC).

TABLE 168

Dose-dependent inhibition of human Yap1 mRNA expression by modified oligonucleotides in UPCI:SCC090 cells

| | % UTC | | | |
|---|---|---|---|---|
| ION No. | 0.04 µM | 0.2 µM | 1 µM | 5 µM |
| 792169 | 100 | 108 | 112 | 84 |
| 715487 | 70 | 37 | 26 | 14 |
| 1198440 | 60 | 26 | 10 | 5 |

Cell Proliferation Assay

Cultured UPCI:SCC090 cells at a density of 1000 cells/well were treated using free uptake with modified oligonucleotides diluted to concentrations described in the tables below. After approximately 144 hours, cell proliferation was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 169

Antiproliferative effect of modified oligonucleotides in UPCI:SCC090 cells

| | % UTC | | | |
|---|---|---|---|---|
| ION No. | 0.04 µM | 0.2 µM | 1 µM | 5 µM |
| 792169 | 100 | 104 | 99 | 93 |
| 715487 | 92 | 94 | 72 | 68 |
| 1198440 | 101 | 92 | 75 | 70 |

Example 30

Activity of Modified Oligonucleotides Targeting Human Yap1 in a Human Hepatocellular Carcinoma SNU449 Xenograft Tumor Model (Alone and in Combination with Sorafenib)

Modified oligonucleotides described in the studies above were tested in a hepatocellular carcinoma SNU449 xenograft tumor model. In addition to testing the modified oligonucleotide by itself, combination therapy with sorafenib was also tested. A control oligonucleotide 792169, described herein above, was also tested.

Five million SNU449 cells in 30% matrigel were implanted subcutaneously into the fatpads of female NOD.Cg-Prkdcscid Il2rgtm1Wjl/SzJ mice (from Jackson Laboratory) at 4-6 weeks of age. 43 days post implantation (when tumors had reached approximately 100 mm$^3$ in size), groups of eight mice each were administered with 50 mg/kg modified oligonucleotide daily for 10 days (loading dose), following which they were administered with 50 mg/kg modified oligonucleotide four times a week for one week, following which they were dosed with 50 mg/kg modified oligonucleotide thrice weekly until the end of the study. Another group of 8 animals was treated with 30 mg/kg of sorafenib orally 7 times a week until end of study. A final group of 8 animals were treated with a combination of 30 mg/kg of sorafenib orally 7 times a week for 11 weeks and 50 mg/kg of modified oligonucleotide 1198440 at 50 mg/kg 5 times a week for 3 weeks, 4 times a week for the following week, then 3 times a week for the duration of the study (7 weeks). Animals were sacrificed, and tumors were collected on day 119 post implantation.

Measurement of RNA

Yap1 mRNA knockdown in tumors was measured by RT-qPCR as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated animals (% control).

TABLE 127

Yap1 mRNA levels in tumors

| Ion No. | % control |
|---|---|
| PBS | 100 |
| 792169 | 90 |
| 1198440 | 34 |
| Sorafenib | 103 |
| 1198440 + Sorafenib | 42 |

Measurement of Tumor Volume

Tumor volumes were also measured at the indicated days in the table below. Treatment with ION No. 1198440 led to significant reduction in tumor volume. In addition, combination treatment of ION No. 1198440 with sorafenib led to further reduction in tumor volume.

TABLE 128

Tumor volume (mm$^3$)

| Days Post Tumor Implantation | Average Tumor Volume (mm$^3$) | | | | |
|---|---|---|---|---|---|
| | PBS | 792169 | 1198440 | sorafenib | 1198440 + sorafenib |
| 43 | 111 | 111 | 111 | 112 | 111 |
| 46 | 175 | 162 | 152 | 145 | 162 |
| 50 | 208 | 180 | 168 | 159 | 162 |
| 53 | 252 | 247 | 201 | 173 | 210 |
| 57 | 292 | 280 | 242 | 200 | 224 |
| 60 | 362 | 317 | 263 | 234 | 258 |
| 64 | 396 | 397 | 338 | 217 | 210 |
| 67 | 438 | 466 | 376 | 277 | 250 |
| 71 | 463 | 519 | 373 | 249 | 241 |
| 75 | 570 | 559 | 401 | 283 | 279 |
| 78 | 597 | 634 | 429 | 322 | 296 |
| 81 | 657 | 681 | 514 | 391 | 400 |
| 85 | 760 | 785 | 606 | 416 | 380 |
| 88 | 786 | 889 | 613 | 451 | 413 |
| 92 | 955 | 1170 | 690 | 508 | 421 |
| 94 | 1048 | 1215 | 773 | 581 | 495 |
| 98 | 1114 | 1355 | 804 | 625 | 525 |
| 101 | 1175 | 1417 | 818 | 685 | 541 |
| 105 | 1252 | 1509 | 894 | 671 | 495 |
| 108 | 1284 | 1571 | 921 | 663 | 470 |
| 119 | 1431 | 1697* | 978 | 747 | 584 |

*Average of 7 samples

Measurement of ERK Activation

Sorafenib is a RAF inhibitor used for treatment of several cancers including hepatocellular carcinoma. However, it leads to ERK activation in HCCs, which impacts therapeutic efficacy (Chen Y., et al., *Overcoming sorafenib evasion in hepatocellular carcinoma using CXCR4-targeted nanoparticles to co-deliver MEK-inhibitors*, Sci Rep. 2017; 7: 44123).

The effect of modified oligonucleotide in mitigating the ERK1/2 activation mediated by sorafenib was tested. Protein analysis was carried out using standard procedures. The primary antibody against Erk1/2 was rabbit mAb 4695, Cell Signaling Technology, and against pERK1/2 was rabbit anti-phospho p44/42 antibody 9101, Cell Signaling Technology. ERK protein levels were compared to internal control GAPDH. GAPDH levels were measured using rabbit mAb 5174, Cell Signaling Technology as the primary antibody. The secondary antibody used was donkey anti-rabbit NA934, GE Healthcare. pERK/ERK levels were calculated relative to PBS control to determine % activation of ERK1/2. Combination therapy of ION No. 1198440 with sorafenib led to a significant decrease in ERK1/2 activation mediated by sorafenib treatment alone.

TABLE 129

| Ion No. | Tumor volume (mm³) % activation of ERK1/2 |
|---|---|
| PBS | 100 |
| 792169 | 100 |
| 1198440 | 88 |
| Sorafenib | 142 |
| 1198440 + Sorafenib | 68 |

Example 48

Activity of Modified Oligonucleotides Targeting Human Yap1 in Combination with Sorafenib in SNU449 Cells Modified oligonucleotides described in the studies above were tested at various doses in hepatocellular carcinoma cell line SNU449. ION No. 792169, described herein above, was used as a control modified oligonucleotide. ION No. 715487 was used to target Yap1 RNA. Cultured SNU449 cells at a density of 5000 cells per well were treated using free uptake with modified oligonucleotides diluted to concentrations described in the tables below in combination with sorafenib diluted to concentrations described in the tables below. After approximately 48 hours, Yap1 mRNA levels were measured.

Measurement of RNA

Yap1 mRNA knockdown in tumors was measured by RT-qPCR as previously described using the Human Yap1 primer-probe set RTS4814. Yap1 mRNA levels were normalized to actin-beta content, as measured by primer probe set RTS5002. Results are presented in the tables below as percent control of the amount of Yap1 mRNA relative to PBS treated cells (% control).

TABLE 170

| | Yap1 mRNA levels | | | | | | | |
|---|---|---|---|---|---|---|---|---|
| SORAFENIB | YAP1 mRNA (% control) | | | | | | | |
| CONCENTRATION (uM) | 715487 at 0.04 uM | 715487 at 0.2 uM | 715487 at 1 uM | 715487 at 5 uM | 792169 at 0.04 uM | 792169 at 0.2 uM | 792169 at 1 uM | 792169 at 5 uM |
| 0 | 98 | 54 | 30 | 9 | 115 | 113 | 103 | 103 |
| 0.37 | 97 | 51 | 23 | 8 | 97 | 96 | 99 | 104 |
| 1.11 | 77 | 44 | 22 | 7 | 100 | 97 | 93 | 95 |
| 3.33 | 83 | 45 | 21 | 7 | 99 | 91 | 92 | 97 |
| 10 | 78 | 46 | 20 | 8 | 102 | 94 | 93 | 97 |

Cell Proliferation Assay

SNU449 plated at 1000 cells/well were treated with a combination of modified oligonucleotide and sorafenib at concentrations outlined in the table below. 144 hours post treatment, proliferation of SNU449 cells was measured using the luminescent cell viability CellTiter-Glo® 2.0 Assay (Promega). Results are presented in the tables below as percent control of the amount of luminescence in samples treated with modified oligonucleotides relative to untreated control cells (% UTC).

TABLE 171

Antiproliferative effect of modified oligonucleotides in SNU449 cells

| SORAFENIB CONCENTRATION (uM) | % UTC | | | | | | | |
|---|---|---|---|---|---|---|---|---|
| | 715487 at 0.04 uM | 715487 at 0.2 uM | 715487 at 1 uM | 715487 at 5 uM | 792169 at 0.04 uM | 792169 at 0.2 uM | 792169 at 1 uM | 792169 at 5 uM |
| 0 | 98 | 93 | 84 | 64 | 99 | 97 | 97 | 86 |
| 0.37 | 102 | 94 | 83 | 64 | 103 | 100 | 95 | 84 |
| 1.11 | 93 | 77 | 45 | 23 | 97 | 91 | 89 | 68 |
| 3.33 | 27 | 12 | 5 | 3 | 51 | 30 | 27 | 6 |
| 10 | 2 | 2 | 1 | 1 | 3 | 4 | 3 | 1 |

Example 49

Activity of Modified Oligonucleotides Targeting Human Yap1 in Combination with a-PD1 Antibody in DEN-HCC Model The DEN model is a chemically induced model of hepatocellular carcinoma (HCC). N-nitrosodiethylamine (DEN) is administered at 25 mg/kg into 15 day old C57/BL6 mice. Carcinomas form 6 months post injection. After formation, carcinomas were then dissected from the liver and passaged subcutaneously into C57BL/6 male mice at 4-6 weeks of age to establish a subcutaneous model. For this experiment, mice were passaged with P8 subcutaneously established DEN carcinomas, rendering P9 for the duration of the experiment. Subcutaneous carcinomas are found to form at 4-6 weeks post implantation. Modified oligonucleotides 792169 (control compound) and 715491 (YAP-1 targeting modified oligonucleotide) were treated subcutaneously into groups of 7-8 mice at 10 mg/kg/week 5 times a week for 11 weeks (total of 55 doses). The PBS-only treated group and the control group were treated 5 times a week for 4 weeks (total of 20 doses). α-PD1 antibody (BioXCell) was treated intraperitoneally at 10 mg/kg/week twice a week for 4 weeks (total of 8 doses). Tumor volume was measured over the time points indicated in the table below. F.D. refers to mice that were sacrificed because their tumor volume became too large. As shown in the table below, mice administered PBS, 792169 (control compound), or α-PD1 antibody were sacrificed before the end of the experiment because their tumor volume became too large.

TABLE 172

| Tumor volume (mm$^3$) | | | | | |
|---|---|---|---|---|---|
| | Average Tumor Volume (mm3) | | | | |
| Days on treatment | PBS | 792169 | 715491 | α-PD1 | 715491 + α-PD1 |
| 1 | 373 | 354 | 356 | 546 | 455 |
| 5 | 553 | 376 | 417 | 673 | 475 |
| 8 | 688 | 414 | 463 | 782 | 558 |
| 11 | 729 | 523 | 461 | 910 | 525 |
| 15 | 856 | 604 | 523 | 911 | 529 |
| 18 | 968 | 633 | 526 | 1127 | 524 |
| 23 | 1220 | 773 | 658 | 1134 | 508 |
| 25 | 1337 | 864 | 659 | 1252 | 513 |
| 28 | 1355 | 802 | 661 | 1412 | 489 |
| 31 | F.D. | F.D. | 740 | F.D. | 516 |
| 35 | F.D. | F.D. | 798 | F.D. | 519 |
| 38 | F.D. | F.D. | 741 | F.D. | 491 |
| 43 | F.D. | F.D. | 723 | F.D. | 440 |
| 45 | F.D. | F.D. | 741 | F.D. | 457 |
| 49 | F.D. | F.D. | 765 | F.D. | 474 |
| 54 | F.D. | F.D. | 780 | F.D. | 552 |
| 58 | F.D. | F.D. | 852 | F.D. | 544 |
| 61 | F.D. | F.D. | 925 | F.D. | 592 |
| 65 | F.D. | F.D. | 896 | F.D. | 590 |
| 68 | F.D. | F.D. | 940 | F.D. | 604 |
| 72 | F.D. | F.D. | 953 | F.D. | 577 |
| 75 | F.D. | F.D. | 985 | F.D. | 675 |
| 79 | F.D. | F.D. | 960 | F.D. | 590 |

SEQUENCE LISTING (2940 sequences)

SEQ ID NO: 1 - DNA, 5408 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 2 - DNA, 129000 bp, Homo sapiens
agccatcatgcctggcatgggaagtttaaacaatgaattacgatttccaaactgaatggcaaggatgttatcttagtctgtttgtgctgctataaaaaataccacatactggataatttataaatactagaattttatttctcacagttccggaggttgggaagtccaagatcaaggcagcaacaggtttgctgtctcatgacagctgctttctacttccaagatggtgccttgttgctgcatcctcttaaagggatgaaggctgtgtcctcacacagcagacagatgaaagggcaaaacagctgaatgctgtgtgaagcctcttgtataaagttcttaatcccatttaggagggaggaaccttcgtgacctaatcacctccttaaaggccccacctctttaatactgatgcactggagacgtttcaacatgaattttggagagacagaaacacccaaaccataacagaaatgaaaagggaagggagtgataggttgcagaaaagggagaggttaaggataaatgagatgtgagtaatgaaataagagaaccagatgattattaagaatatggtataccatagtctgacttcactactggagtatttctggatgatgcagagtacagacgaaggggcaggtggctaaagtgaagtagagatgagggtccattttagttgacaggtcaactaattgggatacgcatgttttgagatagtgatctacctggacattgaaaatgatccaggataagggtgcatctttatacgaagaaggtgactccctattttaagatgctgccaacagataattggtccacaaaatgggcagaagaggaagggagtagacaaaggactgaatatgttatctttatcccctactacaccgtggttgaaattgtataaacgaggaatagtaaattacaaaatcttggttgatgatacagaagtgcttacagaacatagtcactccaaagaccctttcactccacttatcaaagtaattttgtcctcagtttaatggcaggtgaaacaatattgaacaaagcagcctctgctgtatctgaagccctttagttagtgttcatagcagtaaatgctctagtaaagggacagcttctattccaatcccaggttttcaatcactttggttctttttttgagacagagtctcgctgtgttgcccaggctggagtgcagtggtgtgatctcagctcactgcaacctccacctcctgggttcaagtgattctcatgcctcagccacctgagtagctgggactacaggaacatgccaccacacctggctaatttttatgtatttttttttttgtagagacagggtatcaccattttggccagactggtctcgaacttctgacctcaggtgattcccctgccttggcctcccaaagtgctgggactacaggcatgaaccaccgcacccggcccactttggttcctaaagttttctttcaggtaaagtttttaatgcatagtttctgcccaaaggttttgtttgtgtggactgattattggataagagaggaagggactaccaacagggtccctgaggctgtgcttagaaagagagggctgctgcaaggagaggctatgttactacctgtgaaataatctgtgaacatgggacaacaatgacaactgacattgatgtggaactcactgcacgtcccaaactgggctaagtactttatatccattgactcatttaatgccccaacaactatgaggtaggtgttattacccctgatgctaatattaaagaacaggaaataaataacttgtccaaaacctcacagctagtaaatggcagaactgggacctgaactcaaaactctgtaactccagaacctgcaagtctgtcgttaaatgcacttgacatttaggagtgggaacaaatccaagaactagtcatgggtgtcatttactctgatcctttttttcagacaggaaactgggggttcagagtagttgattggaatcttctgttagaattttgagtgtctgaggcctgctcctttggccgagccctaccacaccaagtgatacagatccttcagaattctcctgggcatgttctggctgaaggaagaaattacctttttgctcacggactttttccttgcttaatcctacttatacctttgtttcactagcattgtagacaaaatcattaaaacaagaaagccagatttccttagaatgggcttgtgcatttaaaattagactgatgttgcacaatcctatgaatatatttaaaaaaacagtgaattgcttaaatatactaatatgtacaactattgcaaaaactgtatggtatataaattatatctcaacaaggatgctttaaaaaaaaaaaacccagagtgtatgacttaaaaaacatttctattgtttttgagtggcttccagaagggctccttgtacatcaggtgcctgggatgacctccttgcccattcatttcttattcagtccacattaacggagtccaccgttgggccaggcacagggatagcaggggtagggacccagctccttgaggatgaaagacaggtacagaggcatgaatgcttgtacctgaagacgcactaattttttgggttgcggcttccagtgactattgcaaattcgagtactaaaaaagttgatgtgatttcactatttggaaaatgtagtgtttttgtttcttttaataagttacactgagttacagacctggtctcaaagcttcaattacagtaaccgtttacccctctcaagtgagtttttgcagactaacagataagtgaaacaattacaaaataaagttaatgctgaaaacaatggatctttattaacatcaatgccggctcacggtatctattttaactccaatctatcctcgcggctttaagctcgcacaggcgctccgctcggtcaagccggggtaacgcgaggaggaggaggtgggttcgcacatcctctctccacttctttcggccttggccctttcgcaggtccaggcgaactggaagcgcctttcccgagcacgggcggggaaaaggggccgagcggagcggaagaacttcctgcagccaagggcgcccgcgttctccgcagacaccacagttcggacccggattggacccatcgtttgcggttcgcggggcagaatacggggcacgcttcgggcccctgcccggctgagcgcgggcgaagggcggaccgggccagggcgagcgggtcacgtgcggccgggagaggcgccgcgggccgggagtgtgcaggaatgtagcaacttgcagcgaaaagtttccctgcgctgccggccgggccgcggtgcgggcgggcgcgcagaggaaggaagagccgagaggaggcggggccgcggcggcgcgggcgggcgcttctcctaactttagttttggcgtttgaggcgagtttctgtctcagtcgggcgcagccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggtaacctcgttgcccctctccccgtttccccgtcgggcgggcctcagaccgggggggcgctcgggagccgcggccgccagctctggtcaggggaggggggttgcgggaactctagctggggtgggggtcccgaggcgaagtggaactggagtcgtccactccgccgcggtgaccagctccccactcctcccagagtccggggctgagatttgtttttcccttctgagtttctctctgcggttgcagccccggggggcgtgctttccctccttcttcctttctttcttcccggggttcccgagaggttggcgggagtggaggaggggtggggaggaaggaagggggtggggaaaagtcgggcctgggccgcggtgggcttgcacaatgcgcgcgcctccgcgcgctccgcaccttcgctcccgccgggccgggctgggaaagggggaggggggcctctggcatttgtgtgtgggtgtgttgccagcggcggccgagtttgtgaagttgagccctgggcccctttcctttgcggcctctcggtccacttcagtctcctgggggagtcaaataattgttctcttgttttccagtgttgattagaggtgggggtagaaccggtccatttagttttttgctctttctttccttcccccctcccgtttcccctccccctcccgtaagcatttattttcctcgcggctcaggcgatttcggaatacaggtttcgggcttcccctgcccagactttcctggaagttgtttatggagttctttcacccctgctcttcccttgtgtgttggaacttgggccggcttgctcttatcaaacttagtaggtcgcgtgttggtttcccagttgtagactattatttacagtcggctgaaacgcttttgaattagccacatctgtacgttgcgcaggaactgagttgcgctttacagtaccgaggttttaacacaagcctttgataatacactgcaggttgactcataggccaagtcctgcctagttcaactgtgattaaaagttaatgtttgggaagcgatgactaattctaggatcgccattgctttttaattcttattgcggatatgaacatggctgctattccacatacacaatgttcgattattgtgccaacttgattcagcatagaagtgaaactgtttataatgagtgttaacattccaataggtcccagtggatttgttttgtgtagggttctctctttttctttcttttttatttcttcttctttttttttttttttttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggtatgcttttttctcttacccctcgaagtgggtttatggactcattgtgggtaaatgtatgttggcatgcaccctacagactgcacggtatgttttcaaagtataatacacatagattggatcccccattttgtggcatcagccacaaagaattacaactgggaagtgtactttttcttctagtaaataatttttacaagaatttatatccagcagttctaaaattcataaactattatagttttgtttgttttaaataagtttttaactaagtgttttgcatctgtaaattcgacttttatttctcctaatgatttcctaaatcatacttattctgatgggaaactcaaaaaggtgtatcactttaaggcattaatgactctactgagtccttccagtttccttacctttgtgaatctaggaaattctaactttttgataatcaaactctaatgctaattaaaaatattttaaaaactatgcaagattatgaatagtacaaatctaggttgtaaatactattgttcacaacacaaactggtgactgtaagttctttcatatacatccatttttctatcatgaaaactattttataaaggagaaaacaggcatatggaagttaagatacttgttcagtgtcacactagccaacttagactggaactcagatctttggggtctgaatgcagaattttttctgcttgtatagagttgtggatgtgtgtgagttcttaagttaaaattggactgataacatctttatcttctacatacaaagatatagttgggtttttttcatcctgttcattgtagatggcttttaagaacatttgggcagttcaaatttgttgctctcattaaaatttgtgtaatttgttatgatttctttattgatggcattttatcatggttggaataaatgacgagggcttgatttttcttgagtttgacctagaaaaaaaattaattacttaaaacctagtaaaaaatacatattctttgtgttgtgtttatacttagaacattttagaacttggaaaagcacccataactgcactgacctcttaaaaattaggttttaaaattcactattatttttggaatgttttattcattcagtactagttgcccttacatgtctagtgtggaccaggggaaattcattagatggactgctcatcaatacaattacaaacatttataaaatttatattaaaattatataatattaaaagtatccatttgaaaacctgtgttctccagtgtcgaatattaaatgttgaaattttcctttggtacttagatattcggctgcaattaagcgctgactgggaaatttaaagggactcagttgtgttttttcttttttaatttttcatcttaatattccctaataggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaagtaagtgaaaataatggtgggagacagttatctaagacaaatatgtattggaaaacacagtaaagtggtgtcaagatacagaatatcatttatttttatgttttatttaatatttatgttaagctctgtagctctatcttccatatatatgtttcagtttggtatgacctaaatacctttgttagtatgggtaatattttgaaagctttactgagtcttggttctgagcctctttataatcttttcttttgtggaagtttggttattctcattttgagcttgtgccaaaccttttaattagcctagcacaaaacagaaagaataccatgaaaattttcaaattctgggaattacagggctagcagcgtcttacaaaatacgtatggtgctacttgtatctttttaaataaatattttattggtagagaactacaaaataagtagggcttttgggggagtctaattttacagtattttaaattgtgaaatgacaagcactacaactgaagcttgatgtgacttaccaatatttccccccaaaaatgtaaagggaaataaaaatttttaggtttcatatgcagtcgctcagtggcaaacttctttcaagctagtaggtcttcacaacagaaaccctcctctctgggaaaacaaaaacatgaccgttgggttgtttatttatttttattttttcagtccttttgtgtttaataaaatggcagaattacactaggctgaaaagacataaatagaattttctctcctctgattttgaaattacagataagacctcaatttttttctggcttgtttggatcaagtatatattgaaatgttgactaaaactaattatgatagactgaaattgatgtctttaaaaaagctcacttaatagtgtttaatcaggttgagataataaagtgaaaaacagtgtaagttttgattcggataggtcttgacagtctactcctaaggcaaatgtaacatttatttatcataccagataacaccattaaggatgttttgttgtgtgaatcctagtatgtgttttatattgattgtcttccagggtgggttgctactttgtaatgtaagatagaaagttttgtgacagacttacagaagagcaaaggaaaaggtttgatcatgaaaagttcgtacagtttttttttgccccctttcctgcaactttttcttttcttttcttctttttttttaaaaaaattcattttctggtgtcctggtatccatttcaaaggatcaggtttcaaccagaacagtaaagggcctgagactggaaagtacacacaagtctggcaaactcatctgcatgagcaagatcatttgttctcaagcagacatccaaagtaaatgattgaaagagctgctagctgtgaaggatgtgtcttgaaggggaagggagtggaaacaaaccaggttgttaggaagaaaaagaaaggctgcacttttttgaacctctccctgctgggtcacatgctgacctggggagattgttaaacagcttaatagcctgctttccttctttctttggttgatgctgtggctaaaagtataaggttaaagagcaacatttatgctcttcttcttagttctttgtatcttgtaataattgcttgtaggtgatacctgcctacgatttcattattttgaatgaatgatctttttttgagctgaaatcagtattctagatacagttggccttccgtatctgtgggttcagcattcatggattcaaccaacctctgattgaaaatatttggaaacaaattacatctgtattgactaatgtacaaacttttttccttgtcattatttcctaaataatgtaacaactatttagcctttacgttgtattaagtattataagtaatctagaggtgatataaagtatatgggagaatatgtataggttatatgcaaatattatgccaccttatatgaaagaccagagcctctgtggattttagtacatgtaggaggtcctggaaccaatccttgaccacagatgctaaggaatgactattcatttttcaaagtttccagtgattcttcctttgtgaagaaatgtttctcttaaaggtattgatatatgtagatggattaatgaagggtatataccttccaaccccagtcacctcaattcacccctgtcaactatgggcctgtaaggaagataaaccaggctaaaataaataaatctcaaattatgtcataggagaaaaggttgcaagggtagagagatatttacccggaaaagaaaaaactgggaggaggagagataagacatgattgttgtttcagtgtttctggggaacttttatgtgggagtaggattagtcttactatataagaaatgtgaggaattttgattccatggaagaattttcttatataaaacttttaagaactagaagagttttcctggacaggtaaatcttgctcaataaatgtaggtaaaatcatggttacttggtatctgtcagggattctatggaggcccctaaacattggatgtgggagaagaatgctgtgggcttataaaattttgtattttaaagagtatctgctttatgaacattatgcaatttggagaaaagttatgaaataagattatttcaccttctccagttagctacttccatgatgttatggaccgtatagttgttacaacttctttttgtgtactgaacagacaaatgagattaatatcctaaccattagtcaaagatgatgataaactaagcttttggtgccaagtttctgttgtcaaagttcatttttatcctagttttgatgttttaaaatagggctgtctttgtaatcaatatttatatactttcctcttgtatctaaagaggagtgttgttgtcatcagatgtagaatgaagatttaaattagttgccttacacttgtttccgcaatgaaacattttattttaatgcatctttttagatatttgttggaactgacttttaagttacaaagtctataacttattgagatttatatttggcatgaagaacctgactataaatggtccagacaggcaagacgatgtaatttgagaaaaaacttagaaatgttaagaaacaacccagttgttggccttgtgaccatagatgattgagtttttgaagttagttggcctatcatctagtttccaggcagcatgattactgaaagattataagcaggcaatcattcgttgttttaaagccctccttaggtcagtgagatcttgtggaggagactcataccttactttggcaagtgatacggtggaagtatggtgctagttacatttatcagtggcttgttttcaagctctgggatgaatgtgaagtatgtaaacaaggcttagccatataatatttgttctactacatttactattcaaaactattttctttaccatcgtattgagctttcattttaaaagaattcattctctttatgactctgagagttattaccttcttcagctgtcttacggttttcctacaggaaatagttcttcaagtagttggtcaacaacttcctatttctttataagctgctgaataacttcctgactcagtattctataatatctctggtttcaaggagtgttttacttgcaagtttattttattgactctgatgccttataactattaccatgttcaaagatatgtgttcttatatataatgtaccatgtaggaccttataatttgatttaaggaatctggatcagtgattttaaaagtttgtacatttgcattgttttaataatgttctaataatttttaaagcacagttttgtttcatttccattgtttatcattttctgaataactggccacaatgtttttagtctgcgaagattcaaggttttttgtggctgtgatttgattaagttatattgagtagcttggtatacaatttaaaaaggatatgtttttcagagatttttgacattgcatggcataaaactacccatattcctatattaatttgccttgtagatgtgattgatcgctatacataggctgattcttttttctttctttccttttttttttttttttgagacagagtcttgctctgttgaccaggctggagtgcagtggcacgatctcaactcactgcaacctctgcctcctgggttcgcgtgattctcctgccccatctctacaaaaatacaaaaattagccgggtgtgttggcgcacacctattgtcccagctaatcaggagactgaggcaggagaattgcttgaacctggcaggtggaggctgcagtgagttgagattgcaccactccacaccagcctgggcgacagagccagactctatctcaaaaaaaaaaaagactatgaacatatacagtgtatgttgttatcatatacagtgtacctggtatttatacattgtatacagaacatatacagtgtatcttcataataaagattatgcctctttaaaaggaagtttcatgaagaataaggctatactgtttctttctgtatcaagtataacccagagtttccctttaaaactgaaaagcttgtaattttgccattaaatgttaagttgcacacgtgcacatgtatacacaaacaaaaaaccagttcaaattgcaatcacgaagtatttccctatttgagggaaggccagtctctgcttgtttgtcttgctattgaggctgagtggagagagaagatgaaagtacgcccttagctctggggggtgggggagagcttacttctgctcagtgggtgggcatcccagggaagaatggcacacagtgccacagtgatttagggagagaaccctggagaaactgtattcaccagtggcagaagaaaaacagttggaagatagtagatgtgacagagtaaatagaacatagagattaacatattccctgggaaaaataatggaatttttttagtgtgaactaagaaagaagttcactagaacttctttgcattatttaattaatttgcagcatcattcaaagaacagactgtcacttggtgtgtttaaaaattatgattcttagttctagaaagaattctagaactatctctggaagtttaaatgtagcagactcaattgactgcaaggtggtaggctaattttctttttaaagtcacatttaaaaaaaaataccctttcctaaagctttatcttagccattaaaaaaaaacccaaacatctagatagcatttaaatagttgaaacttggaaaaaaaaaaaacccaggtttttacaaccctaaaataagtcctctttagttatgtagagaaatattttactttgtagttagaaaaataatgtgaattcacagcttaaaatactcagggtatcatgactctgcattgccttgtaccttaaggctttgaggggaggtaaactctaaactgttttattgccaaaatatatatagaaatttaagcttaggaccaatcaaagtgaagtcattttaaaaatcagttgctaagatttaagattattcaaacttaatgctaccctctgtaatagcataatttagccattaattgtggcttgaaagtttttaataatagctgagtagcattgtataaagggaggtcttaaagagctgtgtcgttctataactgtggttactaggtgatgcacttcttacaaaaagggcttctgattctaggattaatcagaactacaagccatgaaagggacattgccgtttctatgaagaagaattgcttcatggttctggttgctcaagtgctgtagcaccaagtttcctgggaacaagtactgccaccgtggaagcacttttatttacgtagggcttgaccccttctaaatgcaaacaaagaagtttggtttaaatcacagcagtcctccccacctcccctttaatattctagacaaggaaaatggtcagtatttaatcctcattttgctcctagcatgagaagaatcataatttttaaacacaccaaccaagtgatagtctgttgtttctttgaatgatgttgcaaattaataaaatagtgcaaatggcagtatctattatttgggttttcttctaccagatattttcagtgctttatttgtggttagtgccattacttcatgtgctgtcactttaatttgtctctctatctctttatgggatgttagtcactcgactatcaagttcttcagcaggattctcagttgggggtgggtgaggggacattttattaaaagctccttcctttgtcttcttccaattgattgcttaacctaaagggagaggagttctgtttgtttttaaagtaaggtatttatttggccagtaagtatgtttagagagttgatacttgcatgaaaattgctgcagatttgatttgggatttggagtaaagatagtgtgcttgttaaagtgttactgtgtgctttgacaaaatggaatgtagtatagaaagttgcttgaaattcaacttctcgtatatcctgaactgactaataaggagcaggcttttgggataaaaagtacatacgctgccacctaggaggtgaagcaagatgtggatttttttttcctgtatatggaaatagatgtgggggttcttttgttttatatttataaaacagtcctccctcactcttattccttcatgtgcggtagtccctccccaccatccatgagtttcctttccaaagtttcagttacctgccatcactgtggtgtaaaaatattaaaatggagaattccagaaataattcatggccagccgtcgtagctcacgtctgtaatcccagcactttgagaggctgaggtgggcatatcctttgagcccaggagttgaagaccagcctgggcaatgtagcaagatctcatctctattaaaaatacaaaaaaattagccgagcatggtggcacctgcctgtagtcccagctacttgggaggctgaagtgggagaatcacctgagcctgggaagtcgaggctgcagtgattgtgccactgcacttcagcccagcctgggcaatgggagtgagaccttgtctcaaaaaaaaaaaaaactaaaaacagaaaaccagttcataagttttaaattgcagtgttctgagtagcgtgatgcaatcctgcaatcttgtgctgtccagtctggaatgtgaatcctctctttggtcaatgcatccatactgtctatgctacctcccatgccaccaccccattggtcacttagtagccacctcagttgtcagatccaaagactgtagtatatatataggatatagggttgggtactatctgctgtttcaagcatccactgtggggcttggatcatttcccctgaggataagtgggggactgctgcctctgattttaggcatttcttttaataaggtatattatttttttgtatttgtttggtttattttgagacagtcttaactctgtcacccagacttggagtgcagttgcatgatcactgctcacagcagcttctacatcccaggcttgtgtgatcctcccacctgagcctcctgagtagctgggactacaggcatccaccaccatgcctggctaatttttaaattttttgtagagaccaggttttaccatgttgcccaggctggtctcaaactcctggactcaggtgaaccttaggcatgaaccaccacacctggccaggcatatggtttttgttataaaactaacatttattagagagaatcagaaaattcaggaaaagagaaagggggcctggcgcagtggctcatgcctgtaatcctagccttttgggaggctaaggcaggcagataacttgagggtaggagttcaagaccagcctggccaacagtgaaaaccgatctctactaaaaatagaaggaaaaaaaatgggcgtggtagcccatgcctgtaatcccagctactccttttgggaggctgaggcatgagaatcgtttgagctcaggaggcagaggttgcagtgagccaacatcacgccactgcactacagcctgggcaacagagccagactctgtctcaaaaaaaaaaaagaaggaaagaaaacggaaggaagcaccagattctaccagtgagaggtgtttgaagaaccttgttttcatagcctgtgtgtaaacgtatattttgaaatttaatttttagggaagtaacctgtgcattgatttagaaaatcccttaatactgtaaggtttataaagaaaaagagcaggctgggtatggtggctcacgcctgtaatcccagcacttcggaaggccaaggcgggcggatcacctgaggtcaggagtttgagaccagcctggccaacatggtgaaaccccatctctactaaaaaatagaaaaattaggcaggcgtggtggcaggcgccttaatcccagctacttgggaggcagaggcaggataatcgtttgaacctgggaggtggaggttgcagcagtgaatcgagatcgagcattgcactctagcctgggggacaagagcgagacttctctcaaaaaaaaaaaaaaaaaaaaagcaaagaaaagagcaatgaccctcttttctttatctctggcttgcagcttgcattcttcagaggcaagcactttccactccttctaggtgttttttccgctggtacttttaaaaattccatatttataaaatgtgttacattgctatttcttgaattttcatcacccctcaaaatccttttctttaatcctcccattataatgactataattgttttgttaaatatttttacgttatgacaattcatgttgtgcctacagcagagtcatataatgtactatgattttctggaaaattctgtatttccttgcctggccaactgtgattttgtttttgccgtgattttttgtttttatttctgttgctttttgcccaccttggagctatccttagagtcttttgttttcctgctctgtgctagacttgttgcttcagagttgtcatgttaggatgtgccttggctttcatcctggggagtttctgaatcactcttatgggttgggtacccaatttttctctttctttatttgctcactctttgagtttgttcatcccctagaaatttgcagaagaaaggggtacatgggaggtagctgtgttgagatctcttgtctctaaaactatctttctctgttaacatttagtgggcagtttggttgtagcatttaagcttattttctcgtgaaattttgatggcattactccgttttcttttctttttttttttttcttttttttttcgagacacagtcttgctctgtcacccaggttggagtgcagtggctcgatctcgtctcactgcaagctccacctcctgggttcatgccattctctggcctcagcctcccgagtagctgggactacaggcacccaccaccgcgcccagctaagtttttgtatttttagtagagacggagtttcaccgtggtctcgatctcctgacctcgtgatccgcccaccttggcctcccaaagtgctgggattacaggtgtgagccaccatgcccggccactccattttctttttcttttttttttgtttttttgtttttttgagatggagtcttgctttgtcacccaggctggagtgcaggggtgtgatctcggctcatcgcaatctctggctcccgggttcaagcgattctcctgccttagcctcctgagtagccgggattacaggcgtgtgccaccatgccccagctaatttttgtatttttagtagaggcggggtttcaccatgttggccaggttggtctcgaactcctgacctcaagtgatctgcctgcctcagcctcccaaagtgctgggattacaggcatgagctgctgcgcccggcactccattttcttctagcttccagtttgctaattgagtgtttgctttccttggggattttagtattttgttctttatattgggggtctgaaatttcatgatgtctgttgatatgctcttttaaaattcattgtcaacaatgcctagtcatgtatcagttcatgtaaagaaactcggtcttcaatatggatgatgcccctcaagattttgcagtacagttgccctaaagtacaatttccaggactgtcttttcaggcatggaatctttcagtcctggaaaacatttctttcattagttcccgggtaatttcttccagtctgttttatctgttattttttttctggaattcttgctagtcaggataactgttttaattttcttatcttatcccactattttctttcacttagcattttgttatgttttctgggagatcccttcaactttaacttttaatttttctgttgattttgttttcttttgtttctgagatgatgtgggaggggggcggtctcactctgctgcccaggttcgagtgcagtggcgccatctcagcttactgcaacctctgcccctggagctcaagcgatcctccctcctcagtgtcctaagtagctgggatcacagattgcgtatcaccatgcctggctaagtatttgtgtttttggtagaaatgggtttcaccatgtttcccatggttggtctcaaacttgtgagctcaagtgatctgcccgtgtccaccttcagaagtgctgggattacagggatgagccaccgtgcctagccagatttttttttttttttagacaaggtcttcctctgttgcccaggctggaatgcagtggcacgctcagggctcactgcagcctcaacttctgaacctcaggtgatcgtcctgccttagcctccccaagtagctgggaccggctaatttttgtgtgtgtatgttttgtagagacagggttttaccatgttgcccaggctggtgtcgaactcctgggctcaaatgatccacccaccttggcctcccaaagtgctgggattacaggtgtgagccagtgcgcctggcctgattttcttttttcccaaaaagctatttctcattcttttttttttcttttcttttcttttttttttttttttgagacagagcttcgcactgttgcccaggctggagtgcggtggcacaattttggctcactgcagcctccgcctcctgggttcaagtgattctcctgcttcagcctccagagtagctgggattacaggcatgcgtcatcatgcctggctaatttttttatatttttagtagagatggggattcaccatgttacccaggctggtcttgaactcctaacctcaagtgatccgcctacctcagcctcccaaagtgctgggattactgatgtcagccatatcacgcctggcctgtgtatcattcttaatttacagtgagtcttttctgagctcattgtttattatttttaataacatgctgttcttattttatggttgtagtaatataatatctcccttaggatattatactgtttctttttatattttgtgctgatgccttcattgtctaggtaggcttcattggagagtaatacaacaggagccaagcccggaagttgcagggacccctgaatgccactgtcttagtaatttcctcttttagcagccactatctctagctaagtctgccagtctggagagcaccagtggtgatgggagttaggactgaataccagtgttcttgggcttgacaatgtggggcctcatccctgctctcagctatgtcatgtgtttgaatccagagtctccaggtctgtttctctgaaatctgaataatcgatttcctccttgggccaagcagagaggtatgcagtaggtttttaagaagttgtatgtaagctgaatttttgtgaatccagtttataattacaggttgactataggaagttgccaattttctaagcccaaaacagtgactattagcaattttttatgatttggtttaaaccttacaaaatcactttttactgaatccttgatatggtttggctgtgttcccactgaaatctcaatgtgaattttatctcccagaattcctacatgttgtgggacaaacccagtgggaggtaattgaatcacaggggcctttctttcccgtgctattctcgtgatagtgaataagtctcatgagatctaatgggtttatcaggggtttccgcttttgcttcttcctcatttctctcttgcccccgccatgtaagaagtgcctctcacctcccgccatgattctgaggcctccttagccatgtggagttgtaagtccaattaaaccgctttttcttcccagtcttgggtatgtctttatcagtagcatgaaaatgaactaatacagtacattggtaccagtaaagtggggcgttgctgaaaaatacccaaaaatttggaagtgactttggaactgggtaacagaggttggaacagtttggaagactcagaagaagacaagaaaatgtgggaaagtttggaacttcctagagacttcttgaatggctttgacaaaaatgccgatagtgatgtgaacagtccaggctgaggtggtctcagatggaaatgaggaacttcttgggaactggaccagaggtgactcttgttacgttttagcaaagggactggtggcagtttgcccttgccctagagatttgtggaactttgaacttgaaagagatgatttaggtatctggccaaagaaatttctaagcagcaaagcattcaaaaggtgacttgggtgctgttaaaagcatttagttttataaaggaagcagagcataaaagttcagaaaatttgcagcctgacaatgcagtagaaaataaaaacccattttttgaggagaaattcaagccagttgcagaaatttgcataagtagcaaggagcctaatgttaatccccaagaccaaggggaagatgtctccaggccatgtcagagactttcacgtcagcccctcccatcacaggcctggaggcccaggaggatatggttttgtaggctgggcccagggtccctgtgctgtgtgcagtctagggacttggtgccctgtgtctcagccactccagctgtggctgaaaggggccaacgtatggctcaggctgtggcttcagaggttggaagccccaagccttggcagcttccacttggtgttgagagtgcagttgcacagaagtcaagaattcaggtttgggaacctctgcctagatttcagatgcatggaaatgcctggatgtgtgggcaaaagtttgctgcaggggcggggccctgatggagaacctctgctagggcagtgcagaagggaactgtggggttggagcccccacacagagtccccactggggcactgcctagtggagctgtgagaagagagccaccatcctccagaccccagaatggtagatccactgacaccttgcatcgtgctcctggaaaagctgcaggcactcagtgccagcctgtgagagcagccagaagggaggctgtaccctgtaaaaccacaggggcggagctgcccaagaccatgggaatccatctcttgtatcagtgagacctggagtcacaggagatcattttggagctttaaaatgtgactgtcccactggatttcggactcgcatgggccctgtaacccctttgttttggccaatttcttccattcagaatggctgtatttacccagtacctgtacccgcattgtatctaggaagtaactagcttgcttttagttttacaggcccataggtggaagggatttgccttgtctctgatgagactttggactgtggacttttgggttaatgctgaaatgagtaagactttgggggaactgttgggaaggcatgattggttttgaaatatgaggacatgagatttggaggggccaacggcagcatgatatgatttggctgtgtccccactgaaatctcaacttgagctgtatctcccagaattcccacgtgttgtgggagggactcggcggggggtaattgaattatggggtctagtctttcccgtgctattctcatgataatgaataagtctcacgagatctgatgggtttatcaggggtttccgcttttgcttcttcctcatttctctcttgccactgccatgtaagaagtgcctctcaccttccaccatgatcctgaggcctccccagccatgtggaactgtttaagtccaattaaacctctttttcttcccagtctcaggtatatctttatcagcgttgtgaaaatgaactaatacaatccttaagtgcttttaacaagcaaatgcttacttcatttatatttgtccttatcagtatcagttttgctagcttacctttttgcatgttagattttcttaaagggagaattacagctgtgacacgagagtggttagcattgaatggacagtctaagaattttgttcagaaggtttggattctggtcagagagcctggagatataatttctattcttatgtatgataagggaggtagtcctatctgttcgtttgccatttccaagttcttcatctagttaatatgaacagctttaaaaattagggctttaaagtaaaacagccttatataattattggcctctctctctcttcctttgtctctccctctcttccttttttacctccctccctccctctcgcttccctatccccaaaccctgtgtcccctccccagtctcctgacactgtctctttctttctctcatcagtatagatggtggtaggaaaaatgtttatatctaaattgatcagtaattgtaaatatgcagtatactgcataagttaaccctgagatgtgtttaactgagttttatctcagtttctccctggcaggtggtgctcatttaatagagaactcaaaaaagtagcctgtgttcagtccctaatagaccattgttgatgtcatagaataatttttttttctatatactatcatatggtcaggtaagcatttttagagaatgagttagaatttcatgaagactgggtttaggttaaaatacattcatctgggccaggtgcagtggctctcgcctgtaatcccagcactttgggaggctgaggtgggtggatcacgaggtcaggagttcaagactagcctgaccaacatcgtgaaaccccatctctacaaaaacacaaaaattagctgtgcatgatggtgggtgcctgtaatcccagctgctcgggaggctgaggcacgagaatctcttgaacccaggaagcagaggttgccgtgagccaagattgcgccattgcattccaggctgggcaacagagcgagactctgtctccaaaaaaaaaaaaaaaaaaaaaatttacccatagatgatggctgagatgtgttaggaccctttattgttttttatctcaagttgaatttctccaggttccatttttcagtagtcttgtccttgtttaggtaaaaagtgattacataggaaaatctgttgggtgaaaaggaagcaaaactttttttttttttttttttttcgaaatggggtcttgctctgtcacccaggctggagtgatgcagtggcactatctcagctcactgcaacctccgcctccgcctcctgggttcaagtgattctcctgcctcagcctccccagcagctgggattacaggcatgcaccaccacacctggctaatttttgtagagatggggttttgaactactgacctcaagtaatccacctgcctcagcttcccaaagtgctgggattataggcgtgagccactgtgcctggccagaaaccttttaaaactgcatacaagcaaaaccagaccagagcaccatatagcagtcagagaagagggttttctgagtcataaatattgactcagaaaaaaaattcaatatttttctgagtcaaaaatattgaatggtgtgaggaagagtggaacagaattggtacaccttagttcgtgtaaaataaggaagtgtgtcagaatagccaagtgctaagtttagaaatgagctaaataaatggagattcctgagaccctgcctggaaccaattcttaccagtgttaaggtcacagttaaaatttcccaagctctcccggataatgattgattgattgattgattgattgacaggctctcattccagttgcccaggctggagtgcaatagtatgatcttggctcactgtagcctcaatcctctggacttaggtgattctccacctcagcctcctgaatagctgggactacaagaatgtgccaccacacctggctaatttttgtgtctttagtagagatggagtcttgccgtgttgcccaggctggaatcaaactcctggactcaagcaatctgctcacttcagcctcccaaaatgctgggattacaggcatgagccaccacacctgacctctcctggataactactcttttttttttttttttttttttttaagatttaaaaaaactggtaaagagttgtccaaatacagatgtttctatttttcctctacacatgttcagactgatacaggttatgtttccaaaatcatgtagtttggatgggttcacttttaacccctcccagctggagggtatgcaggctttcctgttaggactagtacagatctcttcttatgggtgagaaaatagtcactgtttctttgcaatgatatgtaagtgtcattgtcctctgtgtttgaggataaaccatgccctctttgtacctgtctgtcttctttgagttggtgcccatcatactgcagataagaatttgcacagcttatcaataagccagttctctctcttccctcaaatactgggtggttttctcaaaaaagacccacatggttcgggataaagtgtttggttacttgctttgatgtagttatagtttctaaaactgtagcccaaaagagtagccaatgcttagtctttagtaggccattgtcgatgttgctcttcctgccattcttttctgtgaactcactataagtgcttttgatctcttgattttataaacacctatgtagtggttttatgtagcaggcgttgttctggatcccactctgtgtaatagggacaaaattaataacatgccagtcttgatggactggataggtctcaaaacttcattgtaagtcatgtgtcttgtttgccttttcattggtaactgtccctcacgattgaggctatgagttcaataaagagagatcttgctgtctttgttcagcattatgtgtgtagctcttgatacatttattggcagatgacatgctatagagtgctcatttatttcagagtccattggtcgacagtcttcctgattgatgactgtagtttctgcataattatgattgcccttttcactcttgaaagtatcccacaatggctgataaattacatatgcgaactagagtatttactatgtgtattctaaagttaattttatgagtttgagattatttttaagctttaacaggaactattaaaaaagggtattgtttgtcttctggatataaagtgacagtagttcactttgtggtattataaattttgttccatgggcagtgaatatctgatttctttaggattaaatgagtaagaaattctgttgtaaaagtgataccaagcctggccaacatgatgaaaccctgtctctactaaaaatagaaaaattagctgggcacagtggtgtgcgcctgttgtcccagctactcgggaggctgaggcaggagaatcgcttgaatttaggaggtggaggttgcagtgagctgagatctcaccactgcatcccagcctgggcaacagagcgagaccctgtgtcaaaaaaaataaaaaaaaagagtgataccggtgagcagacaactctggaaggctgagagaaaagtcatgaggtagtagcatgggtcagatactactcaagtcacgcttaagggagttagcattttcagctagtgattgtgtggacattggaggagtcaaagacagagctgccaaaaggttttctggtaaaaccaaaggtcttttccctccccaccttgaatgacattgcatctcaagagagtcctcgcttgatgctgttaattaattaatctcagtttactttgcattctgactttgggtatttttttcattttttgaaaaacagttcttctgatatcaaaacacttgaaaagccatttaatgacttggttttattcactgtttgagacagattgtttcaaagtgaggactatgcattacacaaacattgttaactataattgtatcctgtatacattttttaaaggtttgttttgatgttggcacctgtttaagattttccttttttgcttctttttgacaccatttgtcagaaaatgctggttgaaagggattgtttgcatttcattttttggtaaattcagcttcatgttcatttgtttaccaataaatttattagaattgtgcaaagtgaatataaaccgtttacacacattggttactcttgtttcagttagtaattatccctgcaaattgaattaatagtaaaatgtgtaaaacattacaattttttactttttttattttttactggcataggggcccggcatagtggttcatgcctgtaatcccagcgctttgggaggccgaggcaggagatcacctgaggtcaggagatggagaccagcctggccaacatggtgaaaccccgtctctactaaaaatacaaaaattatctgggagtggtggtgcttgcctgtaatcccagctactctggaggctgaggcaggagaatcacttgaaccagagagttagaggttgcagtgagccaagatggcgccactgcactccagcctggcaacagagtgagactccgtctcaaaaataaataaataaacaaacaaacaaacaatttggtttaaaaaatactaggattttacttaaaaagatttttaaactcgacaattcttactaagctctaggattttaagtttattaataaaactcttgtggcacacagaatttttgggtttttttgggacagagtctcactctgctaccccagggatggagtacagtggcgatgtcagctcactgcagcctccacctcctgggttcaagcaattctcctgcctcagcctcccgagtagctgggactacaggcacgttgctaccatgctcggctaatttttgtattttttgtagagatggggtttcaacatgttgccaaggctggtttcaaactccaaggcccaagtgatctgcctgtcttggcctcccacagggctgggattacaggcataagccaccacgcctggcctagaattgtttatctaatgtcaaagtttaatatggttttggaaggaagttatgagtttcacacaaatgcttataattaagaaataagtttagatgacaatagcatattaggctgttaagatttcaactctgctgttttgtaggaagccacatggaggtcatttacggttactagttatcttagtcagcttgggcagccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaagggaactgatttcatcatgaggaccctgccactctcatgacctgatctaatcgtaattaactccaaagaccctatctccaaatgtcagcacattgagggattagcacttcagcgatgacttttgggaggacacggatatttagtccaaaacactgttttaactgaaaagagtttgcattatggacgtttatgtttgaaaaatcagctatttaggtagtggtggtctctcactttatttgccattgacttgttagggaaaccttttgctttctcatttcaagatgctagattagtaccttattatcatacttaatctgttaactgtgatttagaaatatcaggatgctataaacaacatggaattatgtgcagatatacgattgagagttggattttttttacatctcagtattgttctgcatattattcagaggtatgtactttgtcctaatatgctatgttatggctctttttttaatctatgaaaaattatatatatttatttatatatgtataatatatatattaaatatatatatatttaagaatgcataaaacacacttattctaaatagtgattttgatggaaatacgcttccaggttaaccactctccaggttaataaagagaatattgctagttccttagaagtcttccacgtacctctcacagatcacatccctttccctctatccagaggtaacttctggccttttattttacctttttttaaatttgagagatagggtctcactctgttgcccaggttggagtatagtggcctgattactgctcactgcagccttgacctcctgggctgaagcgatcctctggcctcagcctcctgagtagctgggattgcaggtacatgccaccatgccagctaatttgttttctagtgtttttttgagatggagtttcactatttttgcccaggttggagtgcagtggcgcagcctcagctcactgcaacctctgcctccttggttcaagtgattctcctgcctcagcctcctgagtagctgggattaaaggtgcatgctggctaattttgtatttttagtagattcgggatttcactatgttggccaggctggtcttgaactcctgacctcaggtggtctgcccacgttagcctcccaaagtactgggattacagcctgaccataatttttaatttttaattttttgtagagatggtgtctcactatgttgcctaggctggattattttttagttttaccatctacatgtgtatttctttcagttacctactactgcataacaaactaccctaaaacttacggcttaaaacaaccattttattgtatcttacaaatttgtgaattagggattcagtcaaggcacagcagggtgattcttttccatgcagcattgatggaggtcactcagtgccattcagctggcagactggatccaaagatagcttcactcataggtcttgcttgcactttgatgtggatggctggaaggctgggcttagctggaactgtgtaccagagtgtgtgtacatggcctttctagcattgcggtctgaaggcagttggatttcttaaatggcagctgagatttcctagagaggcagcctcaagaggcttgggcagaagtttcaagcttcttcaaatctaaccttggacatcccattgtattggtcaggccaatcaccaagaccagaatggattcaagccaaaggaattagacttcatttttcaatgggaggaatagtaaaaaaattggtggtcatttttaatttgccacagttcttataatagttctaatttttaaaattttatataaatgaagtgatatctgcaaatatttttgcagtttgcatcttttgatcaattttgtgggactcgtgaatgttagtatagttcatttttattgctgtatattttcatagctgtgtggctctattgtatagctagaccacagtttatccattctgtcattaaagaacatttgtgttatataaagatgctgcagtgaacattcatgtgtatgtcttctgtgcaaggatttctctgtgtacatacataagaacttttctaggctgtgtaagagtggaattgctgggtcacagggtatgtccagtgcatggtacttttgctggtcttctgtgtttatattagtataccactgtggttttaacttacattgcttgatcaccattggatctgagcatattttcatatacattttggtcatttattttactttctaaagcacttgctcaaatgttttgcccagtgttcttttgaatttttgcccctttttcctgtatgataactgcttgcttttaatccttccatgtgcctaggacagggagccatttttcctttttttttttttttaaaacagggtctccgtcgcctaggctggagtgcagtggcacaatctcggctcactgcaacctccatctcccaggcccaagtgatcctctcacctcagcctcctaagtagctgggactacaggtgggtactgctaccgtgcctgggtaattttgtttttgtttgtttttttggtagagatggagtttcaccatgttgcccaagctggtgtcgaacttctgggctaaagtgatccacctgcctcagcctcccaaagtactgggattacaggcatgagccactgcaccgggctcatttttctatattcgaaaagtttcatatatatgtctttaatcttctcagaattgactatgtatatatgagtgtaggagtttttttctcagatggatatccagttttcctaggacgatttactgaaaagttcactcctcactgattagtgattgcacttctgtccgtaatagttgcatagatctgttactgtattctgtttgttgtctgtcgctgtgtcagtagcactgtcttaattactaaaacattagaatatgtcttgatagtagaggaagtccttttatcttgtcttggctgttctttgttgtagtcagataaatttaagaattggcttgtaaagttccgcaaaggacctcttgaaattctgagattgcaatgaacctatagaaaaatttggagaattggtatctttacattaagtcttctagtctatgacaatggtaaaaacatctgtctcctttgccctttaatgtaaatgtttctataatctgaagatggaactaacaagatctgggttgaaacctcagttctgcttcttactgccttaggacctgaggcaagtcacataaactctctaaactttagttttcttatctataaaataagtggtaatacctactaagcagagttactaagagaatagggtatcatgttaaaaccctgagtgtagaaactagtgcataatatctcttagtgaatggaattaatatactacatctctctctccttaaagtttgtgggatattcagttttaaactgggtgccatataatgttttaatatccttgttaacaaatttatcaaaatcacatatatgggtagaatttaggtgatgggtatatgaatgttcgctgtacaagtcttccaattttgctgtatgtgaagaattttcataaacttttgagaaaaagacaacatatatgaaaaatatagaatgcttaaaagactttgctgcctctccctgctccatgtgaaatcacagtaaagccaagttaaatctgactttttaggttaaatgttttattgaaactattagcacacacatgctcttgtgggttgatttagttctaaatatttcacgttattagagtcattgactttttttttttttttttaaagtcatggagttccttttctcaatatcattaaccttgtaagatcttctaaaagtgtttacaacacagcttataattaactgatttttggagaggtggaagggaactaagttcttttttttttctttttttaaatttccgagatggagtcttgctctgtcgcccaggctggcgtgttgtggtgctatctcagctcactgcagcctccgcctcccgagttcaagcaattctcttgcctcagcctcctgagtatctgggattacaggcgcgtgccaccacgcctggctaatttttgtattttagtagagacagggtttcgccatgttggccaggctggtctcaaactcctgaccctgtgatccgcctgccttggcctcccaaagtgctggaattataggcatgagccactgtgcccagctgatagggaactaagttctttggtgcattggttatcttttgctgcattaactgactatggaaaaaattagtggcctaaaataataattctgtcattcgagttgggctcagctgagcagttcttctgctgatactgcctgaagtcactcatgcatctgtatctgggagctatactggggctggagggtctaggaaggtctctcactcaaatgtctggtgccagctcatctgggcctttcttttcacgttttcaccattcatctgtttagtccaggcttccttaggtgttgctgggaacattccaaaagggggaaggtggaagctttaaggcctcctgaggccattgtacaatttcacttctaccacattctgttgtagattagtttaggcatgaactgaaatggaaaatttagcagaaatggatcctggattttctggtacccgtgtttcgtttaattactttgttgctttctctccctccctgagttcaattaagttgagaaaagtgttcattgttattactgatggattagactttatttgctcttcattgaatgtttcagttaatttacagactagtaaattatctgagtcatcaagttatgtacgtgtatgtgggtatctatatacataaatatagataaaataatgcaggaggcgaatacttgcagtggctttaggatgattgttatattcctgtggttcctgcttcccagaaatgttttctgtgattacatcacacgtgtccaggtttcttatgaatgaacacttaaggagcactgcttcactggagggtaattaacacattctcagacatttaatttcaaaagcaaagcatatatgtctttctctaaaggcccatgaaaacaagttttttttttttctcttcatgaaattgagtgattataaaaactgatttaatccattgtaattttttgttatccaaaagttgattttaaacagtgaatcagatttcggcactgtgattcatactcccaaaatgagtaacatgattagcaggatattcctagttgttctcttgacttaaaaaaaaaaaaagtccatggtgactcctccatttttggtagtggagttgtattgggtctatgaagaggctttgcgagaaaaaagagcagctatttatggagcatttcctcaggcctgcaatttgaagctattatagcaaagttgctgagcaagtccgtgattgcaggccaacagtcattcaagcccccatcctgcagtctgtgtggagtgagttcaaaactactgctgtgcaaagttttccctctgcagtgtttatcagttgcctactttgtaaagagcaagggtttcaggcattctaaacccgctttgttaactggtagattattaagcagttacaggatataagctagtttttgggtgttcgggagattgttcagcatttaagaatacaatgattcccccatcccctactcccttttagttacttaaaatcaaaccatcttatcataaaatgcagattttatgcagatttttccagcagttttacttacgcttataaaaacagatgttgggttgtctgtcaaaggaattatatcctgtagacctggaatctgtgtttgaggggaatttgattttagattgtagattgctttgttgcctacctatgaaaacatcatttatttttgtgtagggttttgtgagctttttttttaaatggtgacagaaaatgaaaatagcctaattgtgttttttatcatcaaaggatgaaattggcttatctgaatttggctggaaaatttgatttggtatcagcaaatgatgaactgaaaatcaatgagctttaatctgctctggataatattaacaggggtttatcctaaataggactcttctaacctgtgaatcttagaacctttccactttttggtgtcaaagttttaaagcatagtagcttttctgtatatatagtctgatagtgtaaaaaaaattgggtgttgttgcatgttattctctgtccctgtaaaaaaaaaaatctgtatttttccattgttctggaaaaaattcaatttcaaggaaaattttatatagctactagaaaattagtttttagcaatatctatgattttcatttcaagaaagcaacaattgataggaattatgttttgaggattgaaatctactctaaattgaaagtgttcacatttaatataataatctaggatatttaaaagtcatatgggcattctataaaagagaagtatttcttaatctgtttcagtaccccccatgccaacaaaactacgcatgatagcaacacacactaaaaagagaaagaacagtgtcattaaaggatgtcccccagattactaggccttttaaaaatgacatcttaggcctggcgtggtggctcacacctgtaatcccagcactttgggaggccaaagcggacggatcacgaggtcaggagtttgagaccagcctggccaacatggtgaaaccctgtctctactaaaaatacaaaaattagccgggcgtggttgtgcgcacctgtaatcctagctacttgggagggtgaggcaggagaatcacttgaacctgggaggtggaggttgcagtgagctgagatcgtgctgtttcactccagcgtgggcaatagagtgagattccatttcccaaaaaaaaaaagacatcttaatccctacgttctcttgggtttcagtaagattgggtgaaatagtgagtttcttaactgtggcagttacaactgagagaaattttctagttctgttacataaattgaaattgaggacatttctatttcactgaatggtggcttttgggaagtggtccttagatgttgttgcctcacctttgtgcctcacccccatcttttccggaacgatttaaatgaaatatacattcccttaagattcagctcaggtgttaattcctctagagagtctacctagatttttcctgtccaaagtctgccttgggagtccctcatggcctttcacaactacactgcattgggaatatgagttttcactttggacttgatattgtgtcttgtgtgcctagcatagagatgcagcacaatatgaatgctcaccaaaaagaagttgagaactattttcgtgttcccagtcatttcagaagcattgacttatttttacctgttttggtgtctttataaagcttcagcaccatgctcagaggtatgggacaaggattgagagcaatgcagtccctgtcctcggttaggaggcaaggtgggtgcaatggtaagaagtggtatgaaaaaatatccagttggcgctaaacaatgtggtaagccctaagtaatgtagcttaggaactcaggaaaaaaagagagacttacttctgtgttggaattcttggagaagtttggtctttggttgtatttgaaagatggataagaatagacagaataggattttattctgtattgaatccttttgttgactttgctttatctgtcatggttttataacaacatgtaattttagtatttctgcatttggttaaaaaaatttcctctcatttgaattttaggtgcctgattgcttattctcctccactagatgtggtaaggcccattggacccaccattgtgtcttatgcacttagcatagtttgtctggtatgcaatagatatttgagaatgtggtgtgccagctgatttactgactgaattctggagcattgttttcctcatttgtaaaattcggggattggaatatgtgattcgtaagaacttttgcagctctaaaatgctgtgaaattcaatagatttcctgtgaattctcaagtctatatatattttctagtgtgataacattgtatttgcagtgtttttcatgtagaataaagtataagtttaatatataaatgttatcattaatccagaagatttagtaatgttggcaataggaggagtattttcagaaggatttttcttactgttacttaactgatattttggaggaaaatgaagaataaaagctctaacagtgacattatagaatttaggtagaaattaagagggagttgatatttagggctgaaaaagagagggccaacctttctagagaaagatcgatgattagtttttggttgtagttttggtaagaatgcaaagtaattttaagcaatatttgtcctgtttgagaaaatgctaacatatcacaaattgtttattatctgtcaaactgtggaaaagaaattaaagaagtttgagattttaacttgcagctgtttctgatttgtacttttctcttagcatgaagactgaggcagtcaccattcctgagagccaaaaaagggccgtcttcagccttctgagggaagagctattcattgatgtcagagccatggcatagccagacactttccatagctttgagaatctattcttgacagtcagttttagttttagactgttttgattgtcaagtacaactcagaagttttgtatgtgtcactttccatagctttcagaatttattctttacaatcagttttagttttagattgtttggattgtcaagtaaaacttagaatttttttttattttatgagtagggtaataatttatacttagatttaatttcaaagaaccgtttgtggctaataagatattttcaaacttttttagtaattgataggaacttcgttttgagcatataacatttgttttatgtcctgcatttgatattactgctttgaagtgagagcaactgtatcttaaatacttaggtgtagtctcttaacgtgtgttacctcttttaatcctcttcatagttaactgttttataaattgggggcctgctttgaagagattaagtaacttaaacaggttcacccgtccaggtatgtgtcactccaaagcaggagcagtttctgtgaccctatggctgcctctctgcaaccattaaaaggttttttttgtttttttgtttttgcccttcaacaagttttggcataggttaagagaaatatagactatattgcgttttctgtagtatctcatatggcatacttattcatttggtgatcagtaaatacttgttgaattaaactggggcacttgctatgttccttaaaagaagtggcatcaataaggaagaattaagtactgttgcagaagctcaccagatgattctgatgtatccatccacttaccaaatagttgttgaatgaactggaaaattttcagatttaagatatgattggcatatactttttcatatcatcaaatacatccatcaagccatgagatgggtagaccctcattgtacagatgtggaaatgttcaccaacattagccagcacaccccccatatctgccccaaccctcaagtttccttgattattttatgtatgtgcgataatgtgtgatactactactacataaactgtaaagggccatatatatgttcccctttattacctgactattgctaacagcagaacacatagtgtaggcatgaaaggaaggctacatagccatcttgttttatctgaaaaccagtgttttaatcgaacaggttacttgttagtacttacatattgacttagaagttgataaagatttcatttatgcttgtgttgctcagtttttgtatgataactgtgaaaacagtagcaaattcaaattgacagtcatttgtcataacctccttaatggaactgtcctgcttggaatttcccacttctgggaatgataagcaataggaatgatttctttcatagtacctgattaagataaagtggccttcatcataaagacgtgtaaagaaaactaagcaaatgtagaggctgacagatatttgtagagggcatcccagcattggcagtccagcctgagaagagacaggatgacctccagggtgctttctggctccagacctgtgatcaagagtccataagcatagctgattgagcactgaaagtagtgattaccagagaaaccaatgtttaatgaaaagtgaaaattcttgacattgtagaaatgattatttatgcctatatacatagagaaatcccagtaatattttctcaactatgtacagaattagttcaggttatatagttcttgtcatgatcttagggccaaattattcccataggagtaaagtacatattcaattgtattatttaaattggagaaaaaaatttatgtaaagaaagttaccttatgccattttagaacctctgctatttaaagtaagtcacctgttgtatgaatttgtaatgtggcttattgatttttctaggatgcatatttttaaagagcagaataagcttctgctttcaggaattcagcctagtatttcaaatgagagctcatgtattgcaacattatttatctatttttgtaaagggctgttaatcacttggtgccaccctgtctgagttgtgtgcttgtagattgttcacatgaaatcacttgatatggcatctcatttctgcaagaattttttctgtatttttagcccaccagcctagcatgaagttaaattatttaatagaaatatttagagaccagaagcttacttttaattttgcgaatgttgccttaccctttttggaataggttactgtttaaaaacgtgtcgatgtagttatgcaatataattcatttatcctacctttggccaaaacacacacacacacacacacacatacacacactcatgctcacacactcatgctcacacacacttattctgtctctctctctccttctccttccctccctctcagctatttctgagcacagagtcttttgtttaaaagagggattagtatgtcaaatttgtttctatattgtatttctgggtttgaagttttactggatacttggtttttggtaaggctgtcatttaatgcctcttgaattattctgcaggagtattagcaagagttgtaaaccggagttcatatgtgaaatgtgagactgtgacctcttgatccagaggccaggactgttgccaactgaaccaaacccttccttttcctaagaatagaagtgctctgcctaatgattggagttcagctcagtgtttttggtgttctccagtaattggttagaatctcaccaattgtgttttgagtggccaagcaagtatttctttgtagggataaagagaggtacaatgtgaataatttctttaaagagttcatgaaggaattctggtatatcagaaataccactgatatgtatgacctgcctctgctcctgccccatagaagttgctatcaaatgtggaaagacactgtggaaagaagtgtccatttttaatgttaaatgtaaccaatttgataagaaacctataataattgtatcatctaggtctctaatacttgaaaacttaagttctataaattataaatattgaactgagaaaaaaattgaaggtaaaagacgttattaggacaaagaattaggttatttgtgaggcagtaaatgtaaaatgttgactgtattttataacctattagtttgaactgttcaaaatcagaacatagtgagcttcacaagttttcatcttatggacaggattaataatacttcataaattcactattcccattctcagatccaagatgccttatatatatttctactttccttactcctttgctcactcattttgctcattggactttccagtatttgcagtgttttgattcctgactgtcttgaagtctttcaggacaaaagtggctatgaagctgctgtctgccagagagactaaaagagaagccctcttctttgacccagatagtaaagatagatcatttgatcaaaattcagttaggtcaagttagttaagtcagaatgtcaaggaatcagtttagttagttaagttagttaaattacatataagtaatgtacttggacaagtcatagaacgatgacctacagattaaggtccatagcctggccccatatcacctttctagcctcatctctccctccctcttttttaattaataaaagacaaatagagacagggtctcactatgttggctaggttagtcttgaactcttggccccaagcaatcctcacacctagacctcccaaagtgcgagggttacaggcgtgagccaccacacccggcctctagcctcatctgcatctgccatctctcctcctcactcctctctcctgcctgtgagacaccaccaattggatgtactgaagagatgcacctcttttacatgttgtatattcatgcatgcattggtagcattgtaaatgctctttactacttcagctacttaccctgagaaggtcttacacacccctcatttttactttatcgtttaaggctctcagatctaactcaaatgtgtcaccatctttttcctgtagctcgtactaataacatttgaacccctcccttatcccaacttctgtagcattactttactcatttttattcctatagcatttcctcaactctaatatgtctattttttacattttaacctctgaaattagggtacttcttacaattcatgggatcttagttttgattaaacaaggtacttccattctggtggagaattgagattctgtgcttgccttgcttctggaactttcattcttgggtccatatctctaattcctcttccagcacgacaactaataatttgtgctcaaatgttgctaaatggaattaaaatactgtgtctggcttttactatattcaggggaatttcaagggcatgatttgttctgaaatctatcaataataacaataatgattagcatttagagagtctttattttgtgctaggcactgctttaattcctttatctggagtaactcagtgagtcttcacagtaactctgttatctctattttatttttgagaaagctagggtacagttcagccaaaatcgtagaactaataagtggcacacttaggattctagctctgttaatctggcaccaaagtccacgtaaccactgttatatactaaaatgtatttgaatgtttatttaaccagctctgcgctttgtgctttagctgcattttttaatgtaatcctcattatagccacatgaggatttatagtgtagtatgccagaacactccagtagtcatctttagatgtaaattctagtctctattctgatactatgaagagataaacatattatagtaaatttctacatgtacatgcgggagtttgagggctaataagatgatctttctagtcttttctaccttttgaaatcattaaatttaattgctgaaataaatccagactctggtggaaatgaactaacattgagcaccttttatgcttaaggcaggtgcgcattatccctatttacagatgaggaaaagaagttcaaagatgaaataatatgaccaacttattgaacaagaagtacaggcagaatctgtttcagcattgaatctccacccctgaggatggcttctacacaggcagagcctctgtgatattatttttatttttggggtttttaggaaatcttttttctccaccatttttttatttcaccattaagttatcttaaaaccaggtcattagctgtcttttgcttacgtattttagttattttcaacagcttttactaaacatttcgtaaccatgtacatattacttaatattaaccacaccatttctctgtcatctataccacaggctttaaaaactggcatattagagatattagaatgatagtcatgtgaaaggagaagaaaatgtctactatgtagattttagaaattattggagtatattgtggaagttaaagttatagaaaggattttgaaagcatctttgaattttctagcattgtgttagctttatgactatccttggttatttagaataattaacacagagtagtctatattagacacttaagaattttgaatgcttttactctgttttaaaattctagccagtttcataacatgaaattaatagagcatgcttaaaattgggaaactttggtgtttcttagttgacttgtaagagattgcagctttgatctctaagctgcaagtaaacatctgacttgtctataaacacatggtttcaaggctttgggggagcctaagaagatcattggtttgaaagctgaaataagtgtacatttatgacacttgtgtttctgcaaaaagagaagctttggattaagtttatctgagaaatgttgtgtgatagacaagaactgaaaaaaacaagagctatgacaaagacttaggtggtttagtggtggttcactcagttcaataaatcccgtgtacttaacgtgtgctacacactgatggtttttggatggcattaatgtgcctagtttaaggattccatgagagttcatgatactcagtattggtgtcaacttgggggtaaccatacagcactagaatcattataaagtatttattcaatatatttttaagatattatttctcttactgttctctggacaagacatcagtatctgaaatgcctttcctcaccttctgtctgttcttggtcattatatcaatctacttttaagaacatatacaaattatgctttttattgcacatgtagagatttaatataggaggaaatgtttgaaagtatataaaagccaaaagaacaaataaatgatctcataaccgattgataacttattggctgtatattttcagactgtttaactataatcttttaatattgccaaacagttctctagtacagttataactatttgttgttccactagctgcaaatgatagatagagcctattaaaatattacttttttactgctttgtgtggtattctgatatcttttacctcttcatgtgttgctatgtagtttttgttggttacagtttgaaatatgagttccttttgcttattaaagtgacatttctgggcaaaacaccatactggaggatttggaggaaatcttgaaattgttcctaaaggcaacaaattgaagatatattaatgctatgtaacctgagcacatttagataggagatcaccagccattggagtcaatctgcaacttcctgaacaggcatgttttggagccaggctttgaagaagctgtaggataagagaaggaagagacatggtttgtacagggagatggaataagatgggtatgatatgtatgctggattagaaattgataggataccttcaagagagaaaagaagctagtgagataaagggttcaaaatgaatgttaagccaggagatggatgaaagaggaaggcagatttattgtcaagggaggggaaagactaacatcagttatgtttaagggaagctggcctagcaatttacatggaagtggcttgtgatacagggagtatagtttaagtcttttaaggtatatgtgaaatgattggccaaacttgttattgctgagtatagaaagtaaaaacagaaatggtatgtaaataacttaatattgcttttgtgatcatggaaaagtaggaaggatttgtttgggaaaggaacgatgaatacctttgttttcagttacataaaagattaaattaattttcctcctctttcttgttctgttgcaactttggactccagttggagactggatctcccttattctgtacctgacatcacctggcatgatgactttgctcatagttgttgctcaggaacattcattaactaattgcgtatatgaagaaatatagattactggagtatgtctttccactgctctactgatatttgctaaaaaagagattttgagtagtgtgctttttttttttttttttttttttttttgagacagtcttgctctgtggcccaggctggaatgtagtggcgctatctcggctccttgcaacttccgtctagtggattcaagcgattctcctgcctcagcctcctgattagctgggattacaggcatgtgccaccatgcctggctaattttgtatttttactagagacgaggtttcaccatgttggccaggctggtcttgaactcctgagctcaggtgatcctcccgcctcggcttcccaaagtgctgggattacaggtgtgagccactgcgcccagcctgcttactactttgcacagaaattagaagtatcattttagcatcccttgtcttttgtctgccaatcaagaagtttcagaatgttttgatctttggccaagtaaagtattgccagtcagtgtcttgggagattttaaagtgatgacgtagtgcttagttatcttacatagcaaattgttgagatataaaatatattatcaaatagttcagttaccaattaagcctgcattatataatgtatgtgattatctaatggtttcacccaaatctttttctccctttaaatgacatcctcgagtgtagggattctatcttgtactactcattttttagcccccacatgtctatagcattgtgtatggcttacagtaacttaaaaaaatgtgtgttggcttaatttatgctttaaaccttaaaacatgttaaaaatatattgtcatattaagaatattaatagaaccttgtcaaaaaatttttacacatgcaaatcttttttcagtgaaaacatacatacaaatggtttttttttttttttttggagacagtcttgctctgtcactcatactggagtgcattggcataatcttggctcactgcagtctctgcctcctaggttcaagtgattctcctgcctcaccttcctgagtagctaggattacaggtgtgcaccaccatgccgaactaatttttgtatttttagtagagacagggtttcaccatgttggccaggctggtctcaaatgcctgaccccgtggttgctggtctcgaatgcctgaccccgtgatttgcccacctcagcctcccaaagtgctgggattacaggcgtcagccaccacgcctggctgaacatggtctttattcttaagactagaatagtacttctcaacaagggatgattttgtccctttccttcctgggtacatttggctatgtctgaagacatatttggttgctagaatcatgttaagccctttttcagccagtggggtttagctgaaatgtacttgggttctctcatttaagtggtacagaaatcatacctctgtaatttagcccatggtttccccttgcctctctttcaagaatgcttctccagtctctccagctggctaattttatagattattcagcattgccttcagaggctgtcacctttatgtgtcctcctctgtatcactaggttgtaccaagaacctttccataaacaccctaaacctttttctatcctctatcattttatattcatttatagatcattttatattcatttctaacctctgtcattttatattcaagttgtatctttatggatctttcccactagaagataagctcctccaagtcagggattatgtgttattcattttgatgtcagcagtacttggcacttagtaggtgttcagtaagtgctttagacaaactgtagctcagataatattgtttggcttaggtttagtgcggtttttttggtggtatggagagggttgggattgtggagagagaagctgattgacaggagacttgagttctagttctgcctctacgacccattagtgccatcacctcaggcatggttgagtgaccattatgagttttaattatgtacagagtgagggaggattgggctacaaggttaagaggagcactcatcccataagctgtgtatcacagctcacttaactgaggccagacaaccttattgaacacagctgtgtgtccaggaataaacagaagaggcttcagtgtaactgccagatattttccccataacttaagacagcagattagaaacagtagttaataggaaatgcccaacacctgggagtccaaatgaagaggtcctttcacttatctgtgaaggaacttttggcctatactgtctttattgatggcctggataagtgaactattattgtattcaatctggttcacatatagtcttcagtaaccatttctcaccgctaatgaaaagctatctgtaagatgctgatgaaacagctttgtagtgacttgtttctcaacctctgaggcattgacctgaaagtaatcatagatgctcttctaccagtgaccccgatgttagcagttgttggggaggtgacacataaggcagtggccatgcgactttcactctggcctctgtagattcgcctcgatttgagaggtaagtctgggttttgtctagggaaagccaggctactctgtaagtctgaaaatatgtgttttagtcttattgtgggcccttaattaaatgtccatttctttgtgtataaaatgaaacagttggtcaggtggtctccaagtttctttctgacattgtattcttctgtgtgagtttgcccttcgatttcagcaattctgttatttttatttgcttaatcaccaaatgaagccattcaaaaggttaaactattaagtgtttcaaaagattcagattatgcctggaacatagctgagtaatctgaatatattttagtgtttgcctcaattagtagaagtaagttgtgctgtccttgggtaattaaagggaaacttaacagcctttcttggaaatatatgtattctgggtttttcctcaaaaatgcaggagaggaccattggttctgttagctgctgtgtggaggctgagagagcttagggaaaccttcccaagagcggacatttgagctgtcctcaaagacttgacaggagaggagtggggatgggaaaggaattgaaggcggagatactgtgtgaacaagggcatggagacatgacgtagtgatctacggctgaagtttcctttcaggtgtgaagtgttttttatattttgagaactttgaaattttccttttctcttagattttaatcacatctccatgtggacttcatctttatagactgaggtgttccaattccagttaggcctagtctttgttccatcccttaagccattttcatagttcatcttttgtgtagcagttacatatgtcagttttgagcaatagtgaccaaaattttccacagtatcacagatatgagtgattcacagatggttaaagtcactgcgcactcttccactgctcctccccaccacagttgtagtggacaaaacattttatgaaaactcttacatgtatagaactttgtcttctttttaaaaaggatagcagagaaatcatctttcttttataattcttaggtatgtcagtcttctcaccttaaaatgcaagagtgttttctgatacagcattgaagtatcagttattttctatgtgtttattatatgtgaattagaaattcaatgaagtgagttctgtggataaccaaattgagttcctgcttcaggaacctttctcagtaattattaatctttttagttattggaagaattttgaaaagaatttcaatgaaactcctaatatatttgctgtactcaattatctttcttccaatttagtaaacagcctttttactaactttttagattccgagagcttgagtttgttcttagtgagctgctaggcaattgacatctgacatcttaatgggagactagaataatattcctctccatacagaggaactcttaaaaaaaaaaaaatctgtaagacctagaaacctgtgaacccaccttctgtgtaatcctcatgtaacactaaagatccagcctgctagcatgggtctcatagattgaggcagtctctaagtgatcatgttacttaatatttacagtataacctttttattaatttctttttaatgaccatgactgtgactattagtaacattttctaccagtagccataaaaatccccctcaaaaaggtgataatatatttcatagtataatggaatttcatagtcatttaacttgagaggttcaaagaagaaagctgtattttcactgacaggatcacatttcaattgcaacttaacagaaagcaagttgaatcctagttttcagcctgaacaaatgttctgattctggtgaactagggaatttaaaatatctttatatgattataccacaactgtgttctcttgctttctctctgtaaacatgttaaatccagaggagacagaagggaagacatttaatctgtatttgtaatttggtattgaaagactactgactcttctaagtaagccagtcctgtaagcatgatttgtatgagtgtctagcatttattttctttaaaaaaaaattacacatgcatgtgtatatatatatgtgtgtatatacatacatacagagaaaaacacagcatgttataatcatacaaagagatattaatggatggaagaatgatgggtgactattgcaagaatttttggccatgattgaaagaatcccaccactcttttgccacatacgaaatccacagatctggtaagccaccttaatatctgtcatagtcctacgtgtaaaacttattcactaatttattattatcaccagtaacctttatttagccaagggttcccttacttactttaaattactttgttacttattggtaatttaacacccaatgtgttactaacagttgaaaacttgaatgttgccataaatacgcaatggatatggtttcaggtttgtagctaagtatgattccctcacagcagacatgtgagccaaaagactgaacagtgttgacatcagatattattttatttactttaaaactggttatatggataacatactttgttttgcacaacacagtaggcagtcaataggtgaagtatttgttcctgtttaatggtggcctgttatatatcacagctgctgaagcagaggttcagaaaagtcaaattacttcactgagattgggtaacctaactcccaacttaaataaatctaatgcctttctaccactgtcctgccctcttttctgattgtggaaggccctgaaagcattaccaaagtttcaaagttacctaaataacatttcctaaaaatgacatctaacgaataatgaaacatcaaagtaaaatagattttttatatcatttaatgagtagttaagactaggtaagactctgtgcttagtatctatttgtatggaaaccatctcattatttgacatacattacgtatagaatatgtaacagttaaattgttttatgttttggggcccctccccaagttattttgctaacttacaatatgaatctttgtagatgattgaagacattctgtagtgttaccaaacttgttaaaagtaagtggtaaagaacacagaaggttccttgactgtttgtattattttcatcaaaatggctggaggaggagtgggtggtgtcagcagtttacgttacaagttccatatacactttattttgatgaagaccatttgcccactttgctaagaagcgtttagtgtggattttcctgactcttttcctggtgatttaccctttgggaaatgtttccctcgctgttagacttgtgttgtaataatattttgggtggccgaagccctgttatgttgttaacagttgaaaatttgaatgtcaccataaatatacagtgaatgtggttccagatttgtaactagattccctcactgtagtcgtatgagccagccgactgaacagatccttatttggaagccactggtgtctgatgtggccacagaacactgattataactttgtttgactgcctaaacctgtcttccttcctggtccttggttgagggcattactcctaagtcatgtcatgacaaatgaggtcagagttggtacccatcacatttgtttcatcttcacagttttttttttattctgtgcctagactgacaattataaaatgaaaagataatactgccaatgtctgtaacctatataagaaagttcacttctttttgacatctgacatgtagtagttccatttaaaatagtatttgttcaggaatgtcagtttaagcaaaacagtagaatatgagaaaaccaccaaccatcttttgaagaggttgaattgctattttggctcttttgggtaaataaatgtcttactgtatgtaaagatctgagattatgaaagaacatgtaaaattgctaggtcaattattttcctgaaataactgttgttattcataaaaatacccaggtgctaataagtctgccctgctaattttgatgcaggttgtttgggaaccacattttgaaaaacacttacagcagactttctgtaactaaaatttctcagggctgttttaaaatatttctttatttttagttctgccatttctctttttttgccttttccctgtaaggtgattattacgaaaagagctaggtggaccttatcattggaattctagtctttgttttcagttcatactctaatgacatctgttgttttctatatcatgaaatcaggacaaatacaatttttgaacttttgggaggaatattctcagtcactatggcattaggaaaagatgttcaattttgctgaacgtaacttcaggtacacgccatttgggatcaagattgagagaactgtgcttgcttcaggaagcctccacttgagctttggcattattctcatggctggtccatcctcaccctttccttagggaataatcatttcccaggggagatgtattatatataaacatgtcagcatgtcactttttttgtcaacatgtttaagttgtgtttaaattggtttcatgcttgcgggcaaatgttaattttatcaaacctaaagctatagggtcagattatagtgtggtgtacagtttgtagacttataataaatggtcatgtttgcttttatgtatttctgctcatacttgttcataattttaactcattaacagccttcagtgatagcttaattatttaaatttcaatttaagattctgatatcctgtagtgcagaaaccatattatcatagaggcaaaatgtttacgtcttctcatgcatgtcaaggaaatatagtatatgcataatcactgaatttttgaggttctagaaatagtccaccatggacatatacaaatataaaaagcctatagttgtggtttaggaactgtggctcatggaaggattagattgaacaatgtatcattgttcctagagtcagttaagcgtgtaggtttagctagtttgggaacagcctctagcatgtgactctataacacttgcacaacaaacatgggcctgataagtgagcagtaaatctgggctgactgcccactcccagtactgccatcatagtattttgagggcctgacaacaatattaaaagcttaaaacattcttcacaccgttttgtattattcctggttttccagttttattgtttactaaaagtcaatttttcttaataaaaaaagattgtttagttggtcatttgatttctcattagatactaggctttgtgaggtcttacatatatttaagttcaagttttctcacttttcttcagggaagtgggtgacttggttgtcctgatgtctcttttgggcacataaagcacatttttgtcatgttatctttgttcacttttatcagaaaaaattcagtgtctgagcaggtcactatcatcaaaagtgcatgtttgggtttttttctcttttccccttacaacacaatgaagacagtcttaaaggtgtgttaggggcttaaacacttgacagctgcatttttaaaaaagtttctaattatggtatttggagtgtccataaaaagcttctatttataacgtttgtagattatattaaattcctaacgcctaatttgtgccatctgacatcacgaaatcttagcagacttggaaggaaccagtttgttaggtagctgtgcacaggtacaaacgatttaagattacactcctgggattttgtgaaaaatcggttttacaagttttttagtttagaagaaacatattttcaaaaatggattaagaaaagaggacaaaagatacaatatagttaggtttaagtttaaaaacagtttcattctactgatactagttctagattttaaccaagatggaatcattttacaaattgagagtttcagaggttgcttaactcctcagattagtggtttttgctttatcatggacacaaaatatttaccctccaggcatatgtcgttcttaaaacaatgttgtaggtgatcaaatctcaaagtagtatctaaggcagtgcttctcaaacttcaacgaacatacagaggatctcattaaactatagattcttcatcagtgggttgggtggagcctgagtttctgcagttttaactagctcctgggtgtgctcagtgctgctggcccaaggcccacactcttgaatagcaggggtatgaaagaattgatagtatccattctttgaagtttccaaaccttatcacagtaccagtatcaatgttaatctctttcttagtatattatttttagttatttattttactaacctacatgagcactaacctcctactagtgctttcacaaattagcattataaaattataatcctaaactttgaagataggtataagaaagtcatcagtgttttcattactataaagcccattttgattatgttgttcagtgttccttaaataagggttatagattcagcatttgaaaataaaacacacaatcaagaatttgaagtgtgttttagaatttattaggatgagctttggctaatgcttaagaaatattgtttattctttgctttggtttatattgacagaaccgactatcttatggcttaagtaaaaattgattgtatggaaaggtttttagcaattaatattttgcggcatttggttatagggatgagatttttattttatttccaaattattatgttgttccccttcccctaggagccaatatagtctacacttgctgagttccttttctagttcattctctgtctctctctgtttgtttgtttgtgtttgtttttgctggcgaggtgtttattgacaggttgtggtgccgcacaggtcctcaaagcccagccagccagcaggtacccagggcgcagtgctcagcctgcagcaggagggtctccgttcacatgtccaggcttctggttaattctttccctaagctgatagctctctgcaggttgaagtaacggtccagaaacatttttatcatttctgttccttgccttcaaacctgtggcatctacctactgcatctcttcattacttattggtgaaaaccaaactcctattaaagctcttaaactagacctgtcatcttcacttaactgaactcttatctcatttttaacaaaacatattcttggcccattcaccatgaagtttttcctattttaaatattggggtagcaacagaatgaaatttttgagggctttttgcgtaccaggagtcacagtcctggttgcttttatatatgttactgaatttaattacctcaaccctggaaagtaagtaaataaatcagtcccactttattgaaggtagagcagattgataaaaattgcccacacaatccagattgtcattggcagagctgggattgtaatatacatctgcttgacttttcttttccacagaggagtcttccaaaaggaggaggcttctgggtctttaaaaggttggatagaaattaggtgctttgtgggccagttggggaaaagattacccctggaggaagagtagcgtcaagaaatgtatcagacatttcaaaagaatcaaaaatctatattaaatttgtatagctgacaaaacctgatttacataaaggattttttttttttttttttttttgagccagagttttgttcttgttgcccaggctggagtgcaatggcgtgatcttggctcatcgcaacctctgccccctgggtttaagcgattctcctgccttagcctcccgagtagctgggattacaggcgtgtgccaccatgcctggctaattctgtgtttttagtaaagacagggttcttccatgttggtcaggctggtcttgaactcccaacttcaggtggtccgcccgccttggcctcccaaagagctgggattacaggcgtgagccactgcgcctggcccagcatatttttttaagcttcaaaccaccaacttaaaggtgtagaaatagtaagcataataccgccataaccagtttatctctttaccagtgctatcagttaacaaatcatgaacattgtgtattatgtatattacatgtagctttctgttctgacagcagagtttatgtgctagttctggattcgtcttaatagatgatttgaaaaagaaagcatttaaaaggattctctgtaaaaattctactcggctagtagcaaacttatcattttagaaaaaccgttttttactttgagaccagtaagatggagtgacaagaactcccaagccagaagctaaaagacgtgtttttattcctggtaatgccacataactggaattggcagttgccagtagtacgagaatttgcttaactttcaccagccaatgaagttatttgcttgctttcttacctcctattacagtggaagcaatgcttgtatcctattccttcctgctctctgaaggatgactgtgccccatcaataatccctttgcacatcttcagctactctgtgttcacatttaaacacttgtatcccttcctcttgaaaaaacaagaactcataaccacctatttagctttttatttcctgtgcacaactaaatttgtctgcttctttacttcctactcactgtactctcactgtccctctaaaatggctcttggccagtgtcaccaataatttctttctttttttttttttttttttttttttgagatggaatctggctctgttgcccaggctggagtgcagtggtgccatctcggctcactgcaagttccgcctcccaggttctcgccattctcctgcctcagcctccctgaggagctgggactacaggcgcccgccaccacgcctggctaattttttggtatttttagtagagatggggtttcaccgtgttagccaggatggtctcgatctcctgaccttgtgatctgcccgcctcggcctcccagagtctttctgtgtactttcactacacacacacacacacacacacacacacacacacacacacactaaacaattagccttgtccaatacatactgttttataacctatttttaaaaactgtattattaatattttttcatattatatgttcttctaaaacattttcagcagctgcatacagtccatcatatatatccatgtttaaccaattccctatcattaaatgttaactggctttcaaatgcttgctgtaataaatgatactgaagagatgtttatatataagggttttattacttctggctattaatgcaggatactttttaaggtagttttatttgtataatatatctagtttttctttcattgaaacaatgaaactttgctacaagaaaacttagtacttattgcaagtttgtatgtcagataacgtgctagatgccttgcagtcttacatttcatggtatttagctgttttaattcccaactttatagattaagaaatctatatgtatacatgtatttctcagtaagttaacaattatgtagaaaatgttcagcaaacatcaaagggctttgtgtaagaacatgttattcaggagccacaggggaaaatgaaaacttacagatgaagtttaaagttctgctttggctttggagtatgtaagaagatgacttttggggttttgtggtgttttaccttaaaaaggcgttttaggcctaaaaattatgttatttggcattcttatctctaggagaaaataagtgtatgaatttcttatgaatcttgggttttagtcatatggttactcttttagtttacaaactacattgtatctttgcattagaaggggtaataattatcttaatagttgaagatgatttcctttcacttaaaattccaggcataactttttcagatgttgcacttgtaagatctaagagttgaaagttgagtgatttaagggtgaaaaatgtctgttgcagagggaggctggtgggagcagtgagatgctgtgacttaatgcttttacagagctcgcttggcaccctttgattatgagcccacaagataagaattgtttttggaacctggtatttgtttcctaatgcagtggtttgttttgtcttagtcacatcgatcagacaacaacatggcaggaccccaggaaggccatgctgtcccagatgaacgtcacagcccccaccagtccaccagtgcagcagaatatgatgaactcggcttcaggtgagtgagacactgtaattacagcacatggagtaatgcttacgcattggtaaaagttgatgtggaaaatagtcattactcgtttacagaaactgggacatggtgatgtttattgtctctccagtttcatacagaagacatagtctattttaaaataacgtaagctatattattgccttgtatagttgttaacgcataagggggccgataactgaaagccagtggttctttaagatttggttctgaagcgggtatctcaaatttgtagttctgttaattttgacgtatttggttttattctgctgctttcttgtgtctcaggtatttgagttgaatttaccctcttccctttgtggtttggatggaaagccaagctatagtgttcttattttttattattattattttttttttcattttttttttttgctatggtgttcttaacccaacttttaatgtggtgttattcattctactctgaaaatatctggaaggcagtaacttttgtaaacccaaaagaatatttcttattcccagggcaagcatggattattaaacgcatcttcaccttttttactagaagataaacctgagtataaatctttttctacctcttatttggcaatttacttgaatatgcagtttttctcatctacataatggggagtaacagtgccccttatgatagaagggaagatatgaaaggaaataatacaatttatatgaagcctctagtaattacagagtaggtactaagtgaaagtttagccccttcatcttccttatcacatactgtctggcgtctttctcctttgttaggtgggttcaaggccacagttagcccattatgtacctttgtacatattaggaaaaggtgcccttcctctgggaagatgtaacattgtgcctggcatcagagattggagcatttgggctggatttctgaccactcccctggcccccacgctttaccccgctgctcagtgcccaggttcaggacacagatggcaacaatagtatgtggcagctctagtagacttgatggctttctccaccgcccatgcattttccctagataacaagcatatttagtagctacacagtagatttcttaaacagcagtctttggcaagggactgttgtggttgggtgggaagggtggtaccattagttgacaggagggttccttgactaggcgaattcacagaacttgaaatgtccttctgcccctcgtgctggaatgtttctgctgttacatacctctgctcttgcttttggtgggttgaacatttgagttctaaagagttaagagtggaaaacaaagaaaatggcaacatttgtgattgggcttttcttgacatagactttaaattctgaagaaaaattccttaaatctaaatttaactcattatactacgaatacattctcagaatctcttttatatgtgacacttaagtaaaaattttttttttttttttttattgagacggagtctcactctgtcacccaggctggagtgcaatggcatggtctcagctcactgcaacctctgcctcccaggttcaagtgattctcgcgcctcagcctcccgagctggtactacaggcgcctgcctccacacccagctaatttttgtatttgtagtagagacggggtttcactatgttggccaggctggtctcaaactcctgaccttgtgatctgcccaccttggcctcccaaagtgctgggataacaggcgtgagccaccatgcctggcccctaattaaaaaaattttaagacaaaaattgtacaaatattaatatttttacttggcaactattatgtttttttattaccaaattttcaaataaagttgtgaaatctgccctgtatttatggttaaacaagatgattcacattattcattttgtcatgctccatctaaaaattatctcggcagttaatgacagataacattaatttaaactttattttggaagagtaagtatttcgcgtctaacaaggttgattgtaattcttttagaacattgctttggttgtgtcctattatgttttctgatggtgatggtctagagaaatgagagtatttcggctgaaatttatgctttaagtcaaaggtatgtatcaacttggttttagtgggtttttttgttttttttcttttggatggagttttgctcttgtagcccaggctggagtgcaatggcacgatctcagctcaccacaacctccgcctccctggttcaagtgattctcttgcctcagcctcctgagtagctgggattataggaatgcgccaccacgcatggctaattttgtatttttagtagagaagggttttctccatgttggtcaggctggtcttgaactcccaacctcaggtgatccgcctgtcttcggcctcccaaagtgttgggattacaggcatgagccaccatgtccagccggttttagtgggtttgaaaataattgtggatgttttatttcagctgtatgtcctgggcaggtacagtggctcacacctataatttcagcactttgggagaccaaggtgggaggatcagttgagcccaggagtttgagacccgcctgggaaacatggtgaaaccttgtctctacaaaaaaaaaaaaatagtctgtcatggtggtgcataagtgaagtctcacccagttctcaggaggctgaggtgggaggatggcttgagcctgggaaattgaggctacagtgacctgtgattgcaccaccatactccagcctaggtgatagagtgggaccccatcttaacaacaacaacaaaaatttttgtcttgtttgtaaaatatgaaatgttttaatatattacataaaaattagtatgcatatacatgtctaaataatagagctatatgtagtaaagaggtgactttgacacagtttcagtggagtggcaaaaagcgtgactggagggttaggagtgagggggagaaggcataaaggagagggttgtgaggagagagttggaagaaggaactgaaatgagaaaagccacctctgaagaggcttgagcatgtttacagcgtgctagaaggtatttaacaataataatagtataataataattcttatttatataccaggcattcagtgaaggtccattttgcactgtctcatttaagatcccatgttcttcactgtatgttaaccagggataggataactgacagataggataactgacagagcgaagcctccgataaagcagaagcgacaaggaaccactaacgaacgtcctggaggcgctatttttaaatactattaatagtagataatattggggaactgcttctccagaaggtgatgggtgtggagatgatgtttgtttaaggaggccttgtttcaaataaaatactgttcactcaagagaagagaatattcaaagagagcactcgaggttattgccttttatggggacggtcagacagtatgatggggaagggaagagactagctgatgggtccaaaaccaaaggctttttaaaacatccgcaacacatcgattctaggagtcagtcaaaactttccaaattagagtgaagtgttatcttaaatatatatgaattcccagaatcagacaagtttatatctggattattctgaatttggtcatatggagacctgctgatcaagtgctgagggtactgataatatctttacagcacatgcctctttttcctctaaattacatacacttgtctgttgtcttttcttccatttcagtggaagcccatggttttgacatgttttggaatgaatgtcactgtaatcttgatatacctcatgttcacataaaatagccgtaacgtcatgttgacatgttaataaggtttcagtaagcaaaaggatgctcttctctacttggaaaaatgatcttttaaggagtttttaaaatgttagagacagtgaacaaggacaactgtgagagcatgtaagtaaattttgagggtatttaatgtaacaaagcagaaaatggcttccgtgaagcagggtatctacagaaaagtttcaccctgaagggagtgtcttctgagtctgctaacccgaagccttcacataaaagagaaagctacaccgtgcttttgaagcactctactgggttaatcatgctaaatgcaacttgatttacatttttattactcattatttaataaggacttcctcgctttgcttttttttgaaaaagaattcccatcattcataattgagtccagcttcatgttctgctctgagatcttgttcctcatccaactgctttccttaagatactgtaatttcctctagactccccaaacctgttttctgcataattttcatggttgactaggatgaaagatcttttaagattctttccaattcttaagattttatgaaactctattttgttttctaattggctttagcaaaaatgatcagtataattatgcttttataagtcctttttcaaaatatgaggttgaaatggtagatactacatatagcctagagaccagtggtttgtgattgggcaaatttccaaatatctataactgagaatcacccaaaacaaagatgcacctggaaaaggttctagaggcaacactcaatacatccttggaagaagattaatttatattctttaactgtgccatttaagtggcagggtaaatgacagcaagctttgtgaaagaatttgaaaggtgaagaagaggaaaatggaaaaataagaggaaatggaataatgtattaagataatggttgtactttactttatattaaaatattcaatgtataaatatatgtataaataagtctagtctattaaattacttgaggtgaatgtcctttgaaagttaaaatttatagctgggtgcagtggctcatgcctgtaatcccagaactttgggaggccaaggtgggtggatcatgaggtcaagagattgagaccaccctggccaacatggtgaaaccccgtctccactaaagatttaaaaattagctgagcattggtggtgcacgcctgtagtctcagtgactccggaggctgaggcaggagaatcacttgaacccaggaggcggaggttgcaatgagctgagattgtgccactgcactccagcctggtgacagagcaagactccatctcaaaaaaaaagtcataatttataaggctgggtgtggtcgttcatgcctataatccgagcactttgagaagccaaggtgggaggattgcttgagcctaggagttcaagaccagcctgggcaacatagggagaccccatctgtattaaaaataaaaataaaaattagccaggcatggtggccacacacctgtggtgctagcaacttgggtgactgagattggaaggatagcttgagcccacgaggtcaaggctgcagtgagccatatttgcaccactgcattccagcctggacaacagagtgagaccctgtctcaaaaaaaaagttataatataaattagttattatatataatagccttttgatgcctgcttaggatccgtagtttttctccccatattgagagttaggtaaacatttcatgatttttgtgttcagcattagaaaagaaagccctggggagtgaaaagtgatacttccttagctctatgtgtatgatatatattaaatttttaaatagtgtacttgttaacactgatccacaagattgctgaatcttcaagggacagtaaagtcaaagtatattctgtgataatccagaaataactgtatgacaaatgactaggatcaataaaagttatgtcttgatttatattaagcagaatcaacccatttatctgcttttgagaaatgtacatttgataacaacccaaagcctaaatgtcttattacaggtacattttagagaattcattatttatatgctttaaagttagaaattgttgggatttatttgacagttcccaactctaccaatgtagcactttcagatttctctattatgaaaaactgtgaggatttcctaggaaatacctcaagatgggtggagaaaatgccctcttgatcatgaaaggtgatacgtgttagaggaatgtgctaagcaccttccttgaagtggggaaaaatgttcagaagcaagcaaagtgagtagtatagagctgccttaaggtttgcctcttgtgttctcctgcctgcctgtgtaatatctctcagcactgaagatcaaatgagagattgttaccaagaaaaatgagagagctagaaaatagatgtgaaatataaaaatgatgggtaaattacacattgatttaggttttaactttaaaaagcacagagagggtaaagatgtgagaagttgcagaaccaacagggttgaggtgttggtaattcctgctttatgtgctgtaattcagaaactttaaagttttacttttcacctttgaaactgagagacagtttacattaagggttaagaccaagggctctggaaatcccatggacctgatttgaatcccaggcgtcatctattgtccatgaaatcttggacaagttactgtatctacctgtattcttcacttagaaaaatgagataataactcatagggctgttgtgagcattaaatgacagaatccatatcacatagttaaaatgtattattaatagtgtacagtgcctggtataaatgtgataaaataaatgtgatctgatattttagaatttaatcagtttgtaatacctggtagccactgttactttgttaaaaatctgttaccacactatctttgaagttatgtttatctctgtaggctttttatcatcaaattgaggtcattggctcttccaagtagttggttcctgattcttctaaaagttctggattattataagatggaaattgtcagtctgaagtcacaatatatgggaaaagactatactaacgggaaacctaatagcagtgaactataacaaagcccaaagtcagagcaatgaagagatagtgtatttgactagttactctcgggcttgtattccaaataccttttttaaaaacttttaaaataaaaacacttattttttttgaacaaaattgctgttttctttttcccatctagaagttcaggtaaattaagagaaatggccctataaaatggaaaaatagtataaggaaaagcataataatctggaatcaatatagccaatccttaagaagcttggtttgttttatatagcttgtggcttgatttatttgatgattaagttcctgaaaaatgataatatggaaacaaccaccatttttcttacttaaaactatggccaatccatttcattttaataaaatatgccaatatggaatatgatgacttaaattttttctttttgaaataaaaaaagtaattcagttataatatccagcttgcaaatggcattagcttgtaattattgtatctactctagtatgggagttcttctgaagtctttgttaaacccagtgatggctgataaaggcactttctaatcatcgctcttgacttagctgcataatgaagatgccactcgtgtcagggcaactaatggctttgattttactctgatggtgagagcctttcacttcgtctccactgggaatcactctgatgttgtttaattccagtcatgatttttacagtattaatttcttcattctttgtttaaagaaacccacattcattatgctgagatgtgggtatataattactttgtttttcagtagctgcagatcagtattttttttaatagtgccacatatttttaaaagattatttcagtttgagtatcatgattatccacagtaactatctaaatctcaaatgtgttgaggagtactgtgttttgtatgcttagttacatgcttgattattccagataaggtaattctttcctgtcctctttgctttactttagagattatcttctaaaaagggggaaacatatagaaactcaagactgttgagtgctcttgacctgatcttagagcacagatatcaaatattttaaaaaatttactagaagcctttgaagtaatcatttgggatagtaaagttcatttacattttgaatgttattaagattttaaggtaggccgggtgtggtggctcacacctataatcccagcactttggaaggccgaggtgggcacatcacctgaggtcaggagttcaagaccagcttggccaacatggtgaaaccccgtctctactaaaaatacaaaaattagccaggtatgatggtgggtgcctgtaatcccagctactcaggaggctgagacaggagaatcgtttgaactcgggaggcagaggttgcagagagctgagattgtaccactgcacttcagcctgggatacagccagactctgtctcaaaaaaaaaaaaaagaaaaaaaaaatttagatccatgagtatcatttctaccagctctcttaataaatgacttattacatattggggcataaaaatagaagtatttgtgttcaacttttcttcagtgattatttgtagatttttggaaactttgctcagctttggagtagagagaatgagaaagagattaaattatttccatttaagaaccagctcaaatgcctgttttattctcttgataagtgttggaatattatttttgtctttcccactgatttctaaatccttctggttactctattgctacaataattttatgactcataggaggaatatttgtgtgaaagattaagatgctaattctttaaaaatgatattcatagactaccatatatagtcagcataagtgaaacagaataaatcttgcaacagtactcacagttttccaaaataaggttttcttttgatgttagtaaggtaaggaagtggtaaaactttctttaggttaaaatcttaatgaaaggtattaatttgagcagtctgaagtctaagtgtgctatttgtttttccttcggcaaaactttacagaaagctaatctttaataaataaacttagtaaactaactctaagccatttcattgagttaaaatctaaaggacttaagtggcactgaagaaagtctgaagagttgcatattagtaggctcactgagcttgtacttgaccttttcttctagaaagttcttacagctataacctgacaaacaggaaaatgattttttaagcagtttcatagttttaccttgagataatagtatttttcccttcttaaatcattcattctacaaatatcaaatgccctgctttatactatgccctgtgattgcagaatcaagctaagacagactttttttatattaccataaaaaatgttatggcaggaccaggcgtggtggctcacacttgtaatcccagcactttgggaggccgaggcaggtggatcacctgaggttaggagttcgagaccagcttggccaacatggtgaaaccccgtctctactaaaaatacaaaaagttacctgggtgtttggtgccgtttgcctgtaatcccagctgcttgggaggctgacacaggagaattgcttgaacctgggaggcagaagttgcagtgagctgagattgtgtcactgtaccccagcctgggtgacaagagcagaacttcttctcaaaaaaaaataaaagaaaaagttgtggcagatgtatgcactgagtgctgagaaagtagagagagaggaacacatgagtcagtagtggaaaggaagaacagtgaagaattttttttttttttttttttttttttttggacacagggtgttgctccaccacccaggctggagtgcagtggcacgatcacagctcattgcagcttcaacttcacgggctcaagtgattctcatgcctcagcctcccaagtagctgggactacaggcatacggcaccatgcacagcgtttttttttttttttttttggtagagacaaaaggtgggcatggtagtgtatgcctatagtcccagctttttggcagcttttctggggattacatgtgtgagccaccacactctgccaagacttctttagggaggttcattgatttctttatccaaatattgaatacaaactatgtgccaggcatggttctaagttatgagaacggatatacaatgagtcagatattaaaagtggaagaaagaaaaatagaccagttatggtcagagtgataggctggggatggagggagatgatagcttagattaccttctccagtgcaggtctctgtaattgacgtcttttgagcagagatctgaatgaactgagagtgagagccatgtgaatatctggggaagggagagaatgcttcatgcataacacaacagcccgttcagaggccctgagacatgtttggggaacagcaaaaaggccactgcagcatgaacagagtctgtgaaaggcagaatggggctgcattacagtggtgcttgtaggttttgaacagaggagtgacatggtatcagtaactttttaaaaaatagggagattacttggagggcagttgcagtaacccagggagaggatgaccaaagtggtggtgatgaaagtgattgggttgaggacttgagtactagtggacgagtgggaagttaagttagaagaaaagggaagataaaagtagctagtagatgggcaattactaagccctggaacctctaataccatattgctagtggtaagatgatgagcaatgagactgaagaccacctcagaatggctttgtgtcataagctaagaagtttgagccttgtcctgaaaatgttgggataccattaaaaatcttctttaggggtcttctgctatggttttccctatttttattatctgatcatttgaattttgaaatccaaatatctcattttcttatatttaaagctacttccttaggtatagtatacatgaatttttaatgtttaatatatcattggaccaaaatggtagaactattctaagaaagagtagggaactgacatttaagcacctactgggagccatgacctgtgtcaaacacgtgttttaattctctcaatgatctattgagtgttcatctctgttttatagataaagaaagtgagcatcaagcaggtaaaggaatttgcccaaggttagaaggctaataaatattggatcgatccaagatttgagcccaggtctgtctgaatctaaaccctttatagtctctaaactatactgtctttctggagttgaatatgaaactaaagtcatatgaattttatttataatgtatcaaagattttttaatcaagtaagccactgaatagtacttttgctatattgttaaagtttgagttaatggtacctctagaaaaggttgaatcatacaagcggtccttgttagtctttggtattctagagtagtgcttcttaatttgtaatgtgtcaaggaattacctcgggatttgttcaaatgcagttcttattcagtgggtctgatttagtaggattgggacctgagattctgcatttctaacaattttctggtgatgctgatactgctggttaaaggagtgcacaaatagaatactgttgaatggcttaaacttaaatccatagaaatatccttagagatcattttagcattcctattttaggctggaatgaaacctttactgagtacctaaatacaaatgagtggttccatcatttcatgagctcttatttaatataaaaaccctgcaaaatatatgttacctactttttcttaaatctattatttacaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaatctattatttgtaaaggcacaaaacaagtctctgagagattgcaacttcacaaagaccgatcatacttttccacagataggctcttaatcatgtcagctcagcaaactttggttgtatttggtggcagtgctaagtcctagggatacaaagacaaaaaagtcagcgtctctacttcttgagtctgttgagaagagaaggatgcaggcaaatgattggggtacagggaggcatctgctataaagaggacatgaacatagtagttggggcaccagtatgctggtgcatagaatgcaggtaagtagtagtgccagaattccaatctaagccttcatatgtatggtccacagtttcatcttattctaccacactgcccattgtaatccagaaggggcttggattcatcagcgtgttctagtagtttggcagaagaatcttctaagtacctataggacatgggtgaacctgaactcaggatggggtgggcaggatggattagccaccaaccactctttgtttgcccaaagcttattttcatcagtatgtttatagtatcattagtttgggaggccaaggcgggcagatcacctgaggtcaggagtttgagaccagcctgaccaacatggtgaaaccccgtctctactaaaaatacaaaaattagccgggcatggtggtacacccctgtaatcccagctactcgggaggctgaggtgggagaattgcttgaacctgggaggtggaggctgcagtgagccaagatcgcgccactgcactccagcctgggtgacagagcgagacctcgtctcaaaaaaaaacttatttcttttaccaaaacttgatgtatagactgccttttcttcagtaaatgtttattttcccatattcggcttatcaaagccacaaaataagttagtgataataatatagtcatgtattgcttaatgactgggataagttctgagaaatgggttgctgggtgatttcataattgtataaatatcatagagtaggcttacacaaacctagatggtatagcctattatacacatagactcaatgatacagcttatcgctcttaggctacaaacctggacagcatgttaccgtactgaagactgtaggcagttgtaacacaatggtaagtatatgtgtatctaaatatatctaaacatagaagaggtaatgcattgcactataacattaccttatgacagccacgacatctctaggtgacaggaattttttagctctattataagtttctgggatcaccattctatatgtgatccatcattgactgaaatgtcattatgcagcaaatttgtatataactatttccattgcgtctgcctaaaaatcttagtagtgtgggcagaacttgattagggattgtttaaggcatatatggtcaagcatatgaatttcagatatttatgtttatggaagactcctttgtaaaaaaaaactgaagaagaatcagaggtgatacattttagttcctgtttattttgaaagccaaaagtctgcacaaattgcagaccaaagtatcacaaactactaacaaggcagtggtttctaataaatgttgctatctttgtcctgagcaaccttgcaaaactgtacattcccactcataaaaaatggagaactttttccctatagtctagggcagagtgataagtttttctcataattccacatagcttatagttaaactcagtgtagaagagtgatgaacacaaaacaatacatactgtattcaagaaatcagaacaggtgcaatttaaatttataggtggggaagagtcttactagtgggacagattggagaaaagcttcacaaagatatggcataagaatagagtagaattgggtcaggcacggtggctcacgcctgtaatcccagcactttgggaggcaatgtgggtggatcttgaggtcaggagtttgagaccagcctggccaacatggtgaaacctcatctctactaaaaataacaaaagttagccgggtgtggtggtgcacccctgtaatcccagctactcaggaggctgaggcaggagaatcacttgaacccaggaggcggaggttgcagtgagctgagatcacaccattgcactccaggctgggcaacagagtaagactccgtctcaaaaaaaaaaaaaaaaaaaaaaaaaaaaaaagagtagaatttcagtgggttgaaaacaatggaggctgggaggacacaggctttggggtggacatactgagaatgtagggaggtggaaagtgcatgacacttctgggtactggaaagacaggagtgaacaagccatgcggctgggaggactgaatgaattactaaagtgatagaatcatcttaccagagagaaagcagctgatgaagtaggagaagaaactatatgtagacaagttattaggaagaagtgacattcagagtgggaagggatgagagggagttagctaagcaaagaaggtagagagaagagttcctgcagggagcaactgcagttgtgaaggtcctggagctgggagaggagatgtttgaggaactgagagaagattgaatgaggagggatgtgaaatgatgtggaggaatagatagagcctggcatgttggatgctttcagtaccgaagcagtgctatataatgcctgactatagaggataacccactaaaaatttgagaattttcctttagggagctgagccttgagtcagaggacttcctccttagaggaggtgaggtaagatgatcatgtggctgtggtacatacaaagtttaatgttggagttgaataagaccaatttggaagttactgctaaaactttgtcatggaaatgtgaaagtttatgtgaaagtttcaaggtcaaaagatcgagaccagcctggccaacacagtgaaaccccatctttactaaatacaaaaattagctgggcgtggtggtgagggcctgtaatcccagctactcaggaggctgaggcaggagaatcgcttgaacccagcaggtggaggttgcagtgaaccaagattgcgccatggcactctagcctggcgacagagtgagactcggtctcaaaaaaaaaaaaaaaaaaaagtttatgtgaaagttttgagggacaaatggaaatggcattttgaagaaaccccactcaaaatatgggaacatatcttgtgaagtgtcaaatgtccagttggaggagaaagactagtattgaccctgtgagaggcattaaagatatgggagtcatttatgtgaatatggcaagccatgggatttcatgaaagttccaagaaaagaggattaaaaaaatatgattactgtttgtcataattgtggtgtagtattcaagagcatgatttctggagagctcaactgtcaaggtttgaatctcactctgccacttactaggttgggctgaatgatcctggacaagctaacttttctttgccttagattcctcatctgtaaagtgggtataataatagtacctccatcgtagggttgttaagtgacttaacatttgcttgcaaagaacttaggaaaagtgccgtgtacatagtaagaacagtttgtgaatcatcataaatacacgagaccagaatttcaaaacaagcagcaggcagaatgttcctttaaaaggtcattgaatgtacttttccagctactcttgttactttctaaggaaactacttgataatcctgtactttgtaggactcatcagggtgtgtttagtaaacttcagtgtcctaggtgacttctttattcccaaattgtggggcaggtgacaaggggaggttggtcctctaactcgtggtgtagttaatcaggattttcctgtttgaatagacatggcaaatggttttagttagtcattactaatgcaagagggtccttaggcaagagcaggaagttaatggtgagtcaccttcagtgttatgacatggagtatttctttttaaaatatcacagggagttggtttttgctatagtagctaagttgtcaatcaagtaatactagtagtaaatcttacataaaaactcgcttccctcaagtttaagtagttctaatttatgcattattttatatattgcctactactctctttttgcttatcctgaatcaaatttctcaccctctgtcaatctaattttgtgttgctataaaggaataactgaaactgagtaatttataaagaaaggtttaatttggctcacagttctgcaggctgtacaggaagcatggtgccagcgtctgcttctggtgaggacctcaggaagcttacaatcctagcaaaaggcaagtgggaaccagtgtgatacatggtgcaagaaagtgagtgggagaagtcccaggcttttaaacaaccagatctcaggtgaactgaatgagaactcacttatgaccaaggggatggtgcgaagccattcatgaggtaccccaccccccaccccgtgacccagtcaccccccaccaggccccacctccaactttgggaatcccatttcactatgaaatttggaggggacaaacatccaaaccatgtcaccctctttacgtctcattaaaatgctggcctgtttctctcttcctttttgctatagggcctacttttaatcttttcttcgaaagaagactttggtattggtggtcaggcatgatagcccagccttgaaaagcttccacatctttttcacgtctaagggcccagctttcgagtgtgtaaaagttatttggggtgaaaatgtgtattatccattctcaccaatctagaggttgtcatgagtttgggggattggaattactgtttaataatggtaatcccctttaagtatttactggttgaaataattaaagtttttctggtagattcttaaccataaaaacgaagcgaactgcttattctgccccatccacaggtagcagcctcttcatgcttgcccctgcctggaatgcccatgcccggaatgtcacatgtttggctaggagtgcatttaggtcagagcttacaggtcacttcctgcccttgatctgcttttctaaaaaactgtttcccatttttctttttctttcccatttttcatttttctttctttcatgcatgctgctttatttttgctgcacgtatcattagccaacattgtactgtcttctatctggaacataaattccatcagatagggactatgttgtttattgctccatctccagggcctgaatatagtaggaactcaataaatacttgttgagtaaaagtatttgctatatccctgtcccttcagtttaaatgatacataaaaataatgcagaaattgagcttacatagaaagaatgaaacaatattttgttttacaagcataaacaaaggattttaattacattcatttcagccaacatttattctattttttttttttttttttttgagatggagtctcgcatccgtcgtccaggctggagtgcaatggcacaatcttggctcactgcaacctccaactcccgggtacgagagattctcctgcctcagcctcccaagtagctgggactacaggtgtgcgccaccacacccggctaattttgtagttttagtagagatggggtttcaccatgtcaccatgttggccaggctggtctcgaactcctgacctcatgatcctccctccttggcctcctaatctatttctaattagtagatcctatactggacaaaaatggaaaatgcaaaatatatactcctgtgttcaggaatttcacagtctagccaggaagaaaacatgcataatgaaataatactgaatgagccaggcgtggtggctcacgcctgtaatcccagcactttgggaggccgaggcaggtggatcacaaggtcaggagatcgagaccatcctggctaacacagtgaaaccccgtctctactaaaagtacaaaaaattagccaggcatggtggcgggcgcctgtagtcccagctacttgggatgctgaggcaggagaatggcatgaacctgggaggtggagcttgcagtgagccgagatcatgccactgcactccagcctgggcgactgagcaagactccatctcaaaaaaaaaaaaaaaaaaaaagaagatcaaaacaaaaataataatactgaatgataaatgctatgacatagatataaagaaatttttttactagcacagagaaagaactcttcatctgtattgaggaagtgaaaagttctcaactaaaaatgtttcgaagctaaatggccagtagtaattctcggtcgggcatggtagctcgcacctgtaatcccaccactttgggaggtcgaggtgggaggatctcttgagctcaggatttcgagaccagcctgggcaacataatgagaccccatctctacagaaaaatttaaaaaatagctgagcgtggtggtgtgcacctgtagtcctagctccccaggaagctgaggcaggaggtcacttgagcccaggagtccaaggctgcagtgagccgggattgcaccactgcactccatcctgggtgacagaatgagaccctgcctcaaaaaaataaaataataggccaggctcggtggctcacgcctgtaatcccagcactttgggaggttgaggtgggcggatcacgaggtcaggagatcgcgacaatcctggctaacacggtgaaaccccgtctctactaaaaatacaaaaaaattagccgagcgtggtggtgggcccctgtagtcccagctacttgggaggctgaggcaggagaatggcgtgaacccgggaggcggagcttgcagtgagccgagattgcgccactgcactccagcctgggtggcagagcgagactccgtctcaaaaataaataaataaataaataaaataaaataataactcctatgggtcacatccattctttttacttcctgccacctactccttatttctatctggtcattaaggacaaatgtgaaatgaattttggagacggagaaagactctctcaaaataaataaataaaatttaaaaaaaaacgtactgcccttgtggtgcctgttttgtcatggtagatttgcctaatcctagcagacgtgactgtgtactattcccagacctgcatagattgatctccaaactgcctaaaatgaatagatgtggttgtgtataactcagataaatttgagaaatacttctgtactagctgaagaattctaagtggttgtgttttgtttgtttttgttgttgttttttgagacggagtctcaccctgttgcccaggctggagtgcagtggcgtgatctggctcactgcaacctccacctcccagattcaagtgattctcctgcctcagtctcctgagtagctgggattacaggccctcaccaccacacccggctaattttttgtatttttagtagagacggggtttcaccatgttagtcaggctggcctcaaactcctgacctcgtgatcccctgcctcagcctcccaaagtgctgggattacaggcgtgagccaccatgcctggccctaagtggttgttttaaatcagtggttccttagaccggcatcagcaccacctgggaattttcaggcctgctgaatcaaaaagtataggggtaaggctcagcaacatgtgttttaacaaaccttccaggtgattctgatgaatatttatagcacattataatcagaatataaattgaacataaaggcatcctaaattgattttgatcgagccactgtggtctcctcttacatttatttttgtggtaatcctacatttccccccttggacttaaccttcctgcatcctaaccctagcccaaacagatgattgaaacacattttcactaagtgtaatttgtttcactttcagaaaacatatcactttttgctttctctccttttcatggttattcaacagttagtttaagagaatgacttggaatcctgcattgagaatcaagtcactgaatttcttctaaggaccactggactaaaaattctttttttgtgaataaagcctttatctgtattgttccattaacactggaagaattgtttcttttcagttttctctatcttaattctatgacaaagatagtgtggtgaaaagttatttaaaggtgatcttttctaatctattccttgcctttggtgcgcagctttctttcagtacaaagaaagtatcctattttgggccatctctttccatataacattatattttacccagagagtattaaatgaaagataaaatgaatataaagtattattttgtatttggtatatatgtgttggtataaatgttaattgcaaataatataggttctacatgattttaagcttacagaaagttcaaagtattacttaaaaggcaagacattgattcttccatcaaacatttattgagcagctattcaggtattagcctacaagcttgtaaagaagaatgacttgatcattgccaggagaacagatatgtaatcaagtaattacaattctacctgttaaatgtgcatggagaatggaagaggaaactaatttctgtctgaggtagtatggaaaggctgaattaaagaagtgacatctgagctgtctcttgcaggatgactaagagtttaggaggtaggggatgcagagtatttgtgataatgggaacggcatatacaaggagatggcatgattttatggaaagttggtgggaaaactgggtatctgaagaagacttcagaaatgaatccagctagtaaagaatttaggcattttcctcttgatggagagcaataggaatgttctttagtaagaatgaatgacatgtttaaaagatgaatcgaaaatattttaagaagagaaacccctggtgactgatagaggaccttggagtgagaagagatgacaagccagttactgaggaagtggtcaaaaaagagagctggtaagtattgatggctgagttctctgagatggactgtggcagacccatcggagagaatataagtggaatttacaaaatgaagtgagtggagcaggtagggaaggttggtttgtatcctaggtatctcttgtggctctcattcagacagctaaggtggggaataatgctgtttctgtgtgtgtgtgtgtgtgtgtgtgtgtgtgtgtgtgtttaaaccacatatatgaaacccatatattcaagcaggcttgaaagctacaatgagggccgggcgcggtggctcacgcctgtaatcccagcactttgggaggccgaggcgggcggatcacgaggtcaggagatcgagaccatcccggctaaaatggtgaaaccccgtctctactaaaaatacaaaaaaattagccgggcgtagtggcgggcgcctgtagtcccagctacttgggaggcggaggcaggagaatggcgtgaacccgggaggcggagcttgcagtgagccgagatcccgccactgcactccagcctgggcgacagagcgagactccgtctcaaaaaaaaaaaaaaaaaaagaaagctacaatgagatcttggggttgttgagttgaggctcccaaaggcattcagtgattgctattgacttgttcatcaccatgtatagtcacatggtattttcagtgcctaaaaattttaaatacagttagttgttttgcaaaagctttttataattcagccattttacagttaaagatagtagcaaaccattaatattcagttttggagttctgtctttctggggaggaaatagagcccaaaatgacagtgaaagctggtgagaaaaggtttgatatacatgtgataaacaggtttgcttctcattcagcctctggtaaacttgggatgtgtacaacaaattctacctctggacttggttagtagtgtgtactacacatccaggactgaaggggagccttcctaaggattctaggcatggagaaaactaattccacacgtctgcatttcctaacaggattttaccccatcaaagtagacctttgaaaatgcagctgcaaattgatctgttcctaatacgaatgaaactggcctaaaaataggactttgggtcccatgggccttgtgtgagtggtcagtttaaccaaagttacttattcagcatcacccatgagactggtgtggactgccaatacaggaagaagggaattgttctatttgtgcataggagggatacttaggctctggtcatctgtgggagatgagtgaaaagaagtatagttgtgaagagcagtcagtgggttaggaatcacgctgcctggctttgagtaccattcctggtactaactagctttgggatcttgtaccagactgatcaacctggcactttgtgcctcagtttcctcattagaataagtagtactactgcttatgtcatttgtttactgtaagaattaaatgaattaatgtacataatatataagaacaatgactagcacaagataagtgttcaattcatgttagtccacagaagaaaagattttagccatgtactgaccatcccagtttgtatctcctgccctgcctcttttgattcctgttggaaatgggaactgggggagttgggagggacaaggaaatcaggaagaattatgtttgaatactttagttatttattctgggcctctcttttcattgctgttacctcccaagagcaattgtcttgacttctctattcctataaagataggaaaatccttttagagttaactgtattctttagtcctatctctcaaatgatgttccttaaagtttgccttccaacaactttagcacttatcttgcctcctcccaagcctccaacaagcttaaacttcaaattgcaaccccaacccattagcaatttctggtctgctgaaaaataagctttgtttggactgtagctttctgtcttacagttttcttggtgtgagccactcacataaaacatggaaataaatagagcttggctgtcttagctaaaatgtgctttatattaaatagaatgtttatgatattttcaacgttctaaaaatacttgcatgtatttcttattaatgaaccttggtgttcctaggaaggtattgtcacaaaactgattggattgggtggtagtttctgagctgcaagctcttccgtgtcttatgttaacagtaatagtaattatttgggccatgacttccaaaaggattttttggaaaaaaattttttttcttcatctctgtgttgaggaatattcattttattatttggtggtttctttttagtggagaagaagcaggtatataggtttacctttcttctctgaacacagccttaaatatgtttcaatgaattgttttatgttaagatgtgttttctttttaaattagtaccccctcccacttttttttaggtgcaccaaataaaaaccatgatttttttttttttttctgtattataggtcctcttcctgatggatgggaacaagccatgactcaggatggagaaatttactatataaaccataagaacaagaccacctcttggctagacccaaggcttgaccctcgttttggtaaaggttcatctcaaaacctttttagatgcttttggttgctaattttttttgtaaatatacttcggaaagcacatttaaataaaatcgcattgctttatagtattaaaaaatgaccctgcccacccaatgtttaccagtagtgtttttatccttctcattgtaaacttgagaaatttagatctgaatcagatttttagggctcctcaggttggggtgggggaatgtcataatggccgactaaccagaatcacttgttcctttcacattttgggagaaacacagtgattgtttttaaaatgttttttttttttagctgcaataataatcaggctgtcatgcaacacctcagaccaggagtaccagcttttgtcagtgacctgatgtctgcttgtgcttaggttctgagagtgatgagtaccatcttatgcctgggtgttgtagtgtttcccatcctaaggaggaacatgtcaccccagaaatggcccagtgaaagcattttgccccctcttctgtctctctcgaaaaataaatgtttttttttcttcattcagaaaacaaagaaagccatattcccctccagatctcatgaataaatcacatttgcacaaaggaacccctccccttccaaatgtgtacattttgataagggtgtaaccagttcttcagtgctttttaaaaaatgtgtgtgtgtgtgtgtgtgtgtgtgtgtgtgttttaaactgttttcagtttttcatttgggtttctgagatatttttccaaggccatggaatatgcatctaaaaaagagcagataattgtggttttgaagcttcatcttggactagatgcagctaaatgaaaacaatgtgcagatcactgaataggtcagactgaggggactcggaacctttgaagctttacagggtttgacctaacaacaactgcggggccctcacgggaaagaggaattaactctgtgaatgccatgaaaacacaaccctgcggggggaaaaaagaaaaaactgtatctggagctggttggataaaataacttctccatcgggaatattatgagcagttattttgtgtcttatatatacctttaaaaaaataaattcaagtttgccccaaactgactgaaccccctgttcaagttaagtcaatggcaggatcagggcagtgatgtcattttgacagataaccggtttggcttaaatactgtccttttaagcttcaagacctgtttgggtgttaaaaaaagtaatgaggtatgttaataatttgcaacttcagattctgtttactatttgaattagcccttgtgattggaacaggaaaccaagtaagatagagaatttaataaatgcggccaattgtttggactggaacaataacagccatgtttccttaaattatctctaatgaaatgaatgaattcagtttctccacattttggaaattctgaagaatggtgttgcggaatttttttccctgacataaggttatgaaagatgatgacgaacgctttaccaactgcagagatcaggaagaacaaagctttttaaagaaaaaaattttttcctttaaaacagtgaaataaaacaacttttctgtaagcttaagtagactattgattacacacacagcttggtcttttgttttaagaggaggaggtactttaaaaaaacactaccaccctccagcacgttatgtacacacaggcatacagttagatgtgcccagaaaaagtttcataaaattctcttattgcatttagtttccctttttgggcccaccgtgtgtgtattccagacaggcttgacaatatgccagagctttttattttgtggcccgacttttaatctgttccagaccttttcactcagagagctcaagtgtaactgaaggggggcaggaaagaaaaaaacgtgtgggtttctctgatctagagtgacagcaaatagagacaagctgttagctgctggatttgaagttttccttgaaatcagaagttctgcatagtggattatgttttatctctgccaaagaaatataaactatccccttgtttctgaccctttgggccatacaaacacaaacaaatggtgtaggatattgctttcatgattgtggagtttgcttttcgatattcttcaaatctatattaaaatatttatcaatttttggcttaagtcaagtagatgtgtgtctttcagtgtcttagaatgggagctaagcccctagagaagcttaattttagctccttcaaacaaccccttttatatgtttatttatcagatgctttcagattaattatagttagaatatagccatttgctttaagattaaacatatttagtaattacacttcatttgctgcataataacgtttcagtcagcggcagaccacatatacagtcgtggtcctatatgattctaatactgtgtttttactgtaacttttctatgtttagatacacaaatactacccgttgtgctacagttgcctacagtgttcagcacactaacaggctgtacagttctgtagcttggggcgataggctataccttacagcctaggcatgtagtaggctataccatctaggtttgtgtaagtactctctaagatgtttgcacagtgacagaattgccaatgatccatttcacaaagcatatcctggttattaagtgacacatgactatatttatagtatcaatccttcacatctcacatgaaattaatgttatttatgtaattttagggaataaaagagtaatttgttgtggattgggttttttaatgatttttttctttaacatttaaaagctatttctttaatattttaattttagagaattcattagtaatttataacaaatcatgaagtgacatcagatggcaataaggatgccctgatgtttattgagttttaagaaaaatagggctttttttgtttgtttttttaaggagtcatattaggagtgtttttactctttgttcaagaaaatggttccttgagtattatgcaagccattaaattatttcatataaacacataggaggtgattttttttccctggagattttgtactggcaaacatgagtctcaggtttaaacatcaccttgtatgttgtagatctattactgtatataatacagtcatggacattttccagtaaaaggcctaatgaaaacacaatgaaattataattgctgttcagaatgaaaaaagatctttaaaacactaatagttgataaactgatctttaatgttattttcgctattgtttatattataaaaagatgtattaaaatattgttaccaatctgtgttttaggaaataagtgctgatggcaccactgggataaaaatatttggtgtaaacaaaatattggagcaagagatttggggaaaaaattatacttctgaattttaaagcaagtaatgaacagtccagagtgacaaaaacagaatatttaattcctaactacagttctgtgcacagaaattctatgtgtagaaatgtcagaggtattaaacctcataggttgattttggttcctttgtttcagtttcccaaaacttgctttctgtgcatttacatacacgtgtgtatgtgttactataatgtcttgaaataagaaataaaaggataagtaaaatacaaatacctatatgcaatttattaaaataagactaaagccgaaggttgttgagacttctttttcatcagagttaaatatttggcattaataattaaatatctataaaaattttgagacattcattaacattttttcttttttaagccaaatatttctgttgttaaaaataatattttccttttgatgaaaatgcacctaacaaccaactaaataactaagaatccatcctattagtgttgggggaaaaccactgaagtctctagaaaccaaattggtaactttattaatggagtcttgagcaaagagaatgtcagcatctaattatttaaattttatcaaagcaagtctcttgatagctgtatgctaaaagtgaggttttttttgttctgttttgttttgttttgaggtttgaggctttttttccccttatcaactcaagtctttcctggttatcctgggctgtcagtatttggttatggactacattaattacttagcgtacagaggaaaagatgtgtgttttagataaaaagagctattgcgagctaaaaattattaacagatggccaggtgcggtggctcatgcctgtaatcccagcactttgggaggtcaaggtggatggatcacttgaggccaggagttcctgaccagcctggccaacatagtgaaaccccatctctactaaaaatagaaaaaaatagctgggagtggtggtgcacgcttgtagtcactcaggaggctgaggcatgagaatcacttgaatccaggcggcagaggttgcagtgagtgaatatcatgccactctactccagcctgggcaacagagactctgtctcaaaaaattaagaataaaaataaaaattagtaacaggctggatgcagtggctcacgcctgtaatcccagcactttgggaggccctggtgggcagatcactttaggtaaggagttcaagaccagcctggccaacatggtcaaaccccgtctactaaaaatgcaaaaattagccaggtgtgatggcacacgcctataatcccagctgcttgggaggctgaggcactgagaatcacttgaacccggtaggcagaggttgcagtgagctaagatggtgcactgcattctagcctgggagacagagcgaaactccatctcaaaagccgaggctgatggatcatgaggttagagatcaagaccatcctggccaacatggtgacaccccatctctgctaaaaatacaaaaattagctgggctggtggcacgcacctatagtcccaactactcaggaggctgaggcaggagaatcgcttgaacctgggaggcagaggttgcagtgagcccaagatcgcaccactgcactccagcctgggcaacagagcgagactccatctcaaaaaaaaaaaaaattattaactgataaaactcacaaaatttggccctcataatgagtcctctaatcatcattttttcagtggggagaatgctactcttctgatcactgcagaacattcaacatccctggcccgctaagtgccatagcaccacacagccattacgattcctcggaccaccaacacttttttttttttttttaaatgctgggagagttagggaatatggtctaaaatctgagcccctctgagatcagggaaattatacccaaggttatatagttaaatggcaaaactgaaatttgaatttgatcttttgatacctagaatttaaaagaaatttagattcaatgcagttaatctttcagaaatacctactaatgctgatacatgaaaatttgagagggagaaaaatagtggttaatgcacttgcatcttgtattgtgactcatcttgaataagttacccaaagataatgagtttttctttttttcttttcttcctttattgtttctttcttttttggagagagggtctcactctcatcgcccaggctagagtgcagcatggctcaatctcagttcactgcagccttaattcctgggctcatacaagcctcccgcctgtagctgggactacaggcatgtgccaccataccctgctaatttttttgtgtttttagtagacatggggttttgccgtgttgcccaggctggtctcaaacccctggggctcaagcagtctacctgcctctacctcccaaagtgctgagtttacaggtgtgagccatagggcctggccaagtttctaattacgtaagagaatttaagatctctgattggaacagactttaaaggcatctagttgaattatttacccaattcttgcctcaccgatctcagctttgacctttccctttactagtttacttcattatagtgtagcccattctacttaaggaaaattctaatgaccacaaagtttatatttcttgattacccaaaaatttacttcctttcacatgtgtgaatacagctctaatcccagcagtgttctcttctaactgtggtttctctggtttttcatgtgttcagagttctctgttctttatcaatttactcacttctctggatgtccttcattttgctagtgcttctttaagtgttatattctatagtgtttcatatgtacattatcctgtgagaaaaatagttatgtcattgctctgacctgtcattttcaatctcctccaaaaatctttcttcaatctgcagtagaggctagcatctcttttccacatgatagttacaacaatgtacttgattcaactgaattaaattgggatgtagaaaaatttaccttctcagttggaaatcaagagacccaagttctgctatcacaatataaccaactggatcagaaagatacctaacttctcttgactcatctgtaaaatgtgactggattagactggatgctcttaagaatatttccactctttaactgaatacaatatgctcagtaactgctttggactcttgcttaaggttacttctcaatagcctttttgatttgagtgcattgaggtttcagagatacttttgaactatttattgcaccatttaagtttaactttggtcctctggtcacagtgtggaattacttttgaagaggagacagggaaatcttccagcctttaatctaaagataagccttatcacatggtgagtatgtccaggcaaacaaatctgatggggggtgtgggaagtgctgggctgaatagttaagctttgtccacactctcaaactcttggaagcatatgggagtttaaacatgttcatgttagcaaagttcagctttattgccttaaagatgatgccttgttggtacactttgtttctaaaatttaaaactcccataaagttgccatgacagaaagtctaatgtaagcagatttgaagcctagttccaggccatgtgcttagcaaaacctgatttaagacataccaatagagattgttagtaattattgctctcactacattttctttttccttcaaaagcaagcatttgcttaaatgaatattttaatacataagattatagaatagatttcaaaattagttccacacttgagctctgcagtttttaaaattttatgttaaattcagtaggatatattctaaaaagtaaacaactttagttgtattcctctgtccagtatgtctcaactatgttttgtgaaatttcgctgttcctttttaaaatgttttattttttatctaaaaataaatactttggttagctagggaaaatatccagtaaggtagttccaaaatagtttatcagttatggtaagcaatctctcctgtactaaccaaggctgagtagacatatgttacggaggataaactaataggtaatttctacttgatcagtatttcattgatgcaattagttaattatacagtgaagaaacatttttatctttctttacataatgagtacattgttcatacaggattttttaaacatgaaagtttaagaccagcaacgtcaattagatgatagtttaaactaatgccttattcgtgttactaaagccgctatcaaacacacttaaaaagaccttacatagttttttgggggtttttttttgtttgatttttgtttttttttttttgagacggagtctcgctctgtcgcccaggctggagtgcagtggcgcaatcttggctcactgcaacctccgcctcccgagtagctgggactacaggtgcctgccaccgtgcccggctaattttttgtattttagtagagacagggtttcaccatgttagccaggatggtctcgatctcctgaactcgtgatccgcccacctcggcctcccgaagtgctgggattacaggcgtgagccaccgtgccaagccttttacatagttttttaaaaggaaactttttcaagttatatttgtattaactctgtattaacagcaaacatcttatatgctggaaaagaggaaccatttggtgttgcttgctactttttgtaccaacccaaagattcagatgtaagaaaaagaaagagattatagaattattggaaaggtcaaatttctgttgaaagtaattggtgtgatttagaaggagagtggttcagattctgttttgttttgttttatactcattttgttctgctaccctagttgctaaggtcattttagaactcattctggacttgcttcaacttggagattctcctgtgcattactaatagcatcctcctaactagggagagaaactattttaggatttatttatttatgcaacaaaagtttgggtgccagttacatgccaggcactatgctagccatgggttgggaggaacaagctactaaacaagtaaataaatcattacaaatgtattaagtatggtaaaaggtactaaacaatgtggggtgaaaggaactagggtggtgggaacctgcttgcacctgggtggtcaagggaggtttttcaaaaaggcacataggaagccaccagtcaaatttcagaccagtttttgtgtttttcagtaaaaactctgaggtatgcatcacttctaaattataaattatcctctgtgaaagagctttactagtaataaatgaaattagaaataaagtgttataattgacctgtttattcattaatctaacatgaattaatagtgacaagtatattttaaaagataatgcccctttatttttttaatttttagttttttagagacggtgtatctctgtgttgctcagtctggtcttgaactcctgtcctgaagcagtcctcctgcctcagcctcccaagtagctggtattacaggtgcaaatcaccatgtctggctgcttctctacagtctcattatctgaactttctttcctaactagaccttaaagtttattttcatagtggggaaaaacatctagctgtgctctggggacaaagagagctgaaagctaattagaacacgttctcccttttctgcctcacctcatttagcaacccttgtgtcctgccctaaactgcttgatgaggtgatgaggagaaaatgttctgctggatttctttttgttttcttttagctccattcatgattgtattgtttgaaaaataacattataatgaatttttatggttggaggagggggaagttgaattgactaaagtattgatatttgttaccagtatttttgaacagctaaagatgtgaaaactttaatccagtttggggaggctgggagttggtgctggggaaaaggtttggctgtgtccccacccaaatctcatcttgaattgtagctcccattatccccacatgttgtgggagggaccaggtgggaataattgaatcatgggggcaatttctcccatcctgttctcagatagtgagtgctcgcaagatcttatggttttataaggggcttcccccttccctgagcactgattcttctctctcctgctgccatgtgaaggagtacatgtttgcttccccttttgcaatgattgtaagttttctgagacctccccagccatgctgaactgtaaatctgttaaacctcttttctttataaattacccagtcttgggtatgtctttattaacagcgcaagaacaaactaatacagtaaattggtaccagaagtggggaaagaagtgcagagtgtgggatggagaggttacttagcctgtgacaaaacctagagtaggatgttagagcaggtgaactgtccccacatattgatcattagagaaatgcaaaccaaaaccacaatgagataacacttaactcccattaggatggctaaagttttttttgaaaagataacaaatgttgtccagaatgtggagaaattggaatcctcatacattgctgttgggattgaaaaatgatgtaaccactttggaaaatagaatgacagttcctcaaaacattaaccataacattcccatatgaccgagcaattccattcctcggtatagaggctaaagaattgggaacgtatgtctccacgttgtgggaacgtatgtctccacaaaaacctgtacccaggtttacagcagtattattttataataaatagccaaaaagtgaaaataacccaaatgtccattagttgatgaatgggctaacaaaatgtggtatattcatataatggaatattatttggcaattaaagggaatgcagtgcttgatacatattaaaacatgaataaatctggaaaacattataaatgagaatagccaggcacaaaaggccatatattgcttaattccatttttagaaatgtccagaatgggaaaattcatagagacagaagtagattagtggttgccagggactgggaggaagggcagtaggtagtgaactgctaatggatacagggcttttttgtttgtttttgtttttgtgactttttttttttttttttgaagtgatgaaaatgttctgaaattagatcgtggcaatgggtgtacaattctgtgaatttgtaagaactaccagacagtacatgtaacaagggtgaattatcccagtaaagagaaaaaattatttctaggcatgatgtcatttaggtatatagtgtattgagaaataccttttgtatattgatcataaaaagatgtattcagtcattaggttaggacactcgtcttttccttttcttttgtaaaagatagcttttcagtgtgaattaaaataagcaatttttactgaaaaactacattttatgtttaagtagataaattattatgccactttatagcgactctctattgatgattcagtccccttaggtcatgcagtaaacacttagagccaggagtgagtgttttgtgttttgtttttactgctttaagacccacagatggcctattagtttgtgtttttagaagaacattaatttcttttaaaaagtctactgttttgtagttttgagtacactcgtaggtatgaggaaaacccaaatatttcttctaaatgttttgaacaagttaatatagctatgctaatatggaaatattcagtgtctgagatttgaaaaaatactagacaaaagcttttgttgtgggagatttgatgtaatgttttaatagcttaagaatcgtttattattgtaaatgtatacccagtaagattactagaattaaatttattattccaaagtttatgactaacagatctgtaatacattgttataatccaagttttgaggttacaaatcatgtaaatttttagacaatctaaaaattgtctgaagtttggaaattcacatgtttagaatgaaacttggggaaaaaaaacctatggtgatgacccctttcttttatttttgagaaagtagtcccttatttttcagtaattgctcagtcattggttttctaccataaagctgtcagggctgatttgttaagcaaaacttgaaacagttactatttcgtagtgcaagaagcacagactctaaattttaaaatattgcataatttttaaaattctgacattttgtggggtttttgttttgtttttaccttttggaaattttattaaaactggaaacattgggatttcaatagttgatagccagaggaagaagttggtaatgctattcttttcttttcttgctgccctgccccctttccccaggaaacaaagccggttttgtttcttgcctgcttgtgaggtctctgctgcaccccatgtgggtgcaccgctctgtgctttgttgaaagacttaagatactcagaaggtaaagaacaggatgcttctggagaggaataaatcccagcttcagtagataaacaaggttgtttgaattggtcatttaagtgagttctttctatggaaaccttgtagtgctgcttgtatccataggtaacaacatttaggtaaagccaaaagtactcacaatagtcatcagagtatttctcttacataattttgtgcaagtttctgtttaattctgtggactggttcttccttcatcttttgatatcctaactaatttttcctgttccgtggttttgaatagtcagataagcttagatttgaaaaagaccttaccaaccaattcagtttgttgtcagcattggctattgtcattaatgattactgcttttggtatctaattctgggaaactggtgagaagcaaaggatatttaccactttatttttgtgtaattttattgctattcagtgtttttcaccaagaatgtatgttatttcataaataacttaatgttatgttacataatgaaaatataatggggaaagctcaaaagcttatccaaatgtttcttaatagatgaagtatttaacagtgtatatagctctagaatctgttttgaaatcaatcatgttttataattccaacactcctcagcttactaatgggctattttctagcaggtttttggtgttttgcttttttattgcttggaaccaaaaacacttttccccaatagttgtttgccttgggcctcaatttacgacatgttcattgtatgtgatgaatctcagatcagttccccaattcatatttaactcatgctatcaaacctggcacagcacactgtataaaatgtttctgtgtggaaatatgttgagtgttgtattgaaacaccgagaagatgtttcaccgaaagagaaggatcctcttatatcgttggctcaatctccactaccttttttctatttagaccttgtaggaaagagaaacatgcatatttttgtaaatcataggaatatttggaaacagtaaatggtatgataaaataggaggagggagagagagaatgtatgtgtatgtctatgtgtttgtggaggagaaggagagaggtataggaatcatcaaaatatggaattcgtctgtaggagtcagagtctttaggtttagaaagaagttctgcagaagagagaggactaaggtttatggagcacccactattccaggtgtgtgagagaataatcagtcctcataataactcaaatggagatgtcagtattgatggtacggatgagaaaaccaaggattaagtgaattaccaaattagtatgcccaactctaatccaagttcatttgactctaaaggctgtgttttttatgatacctgtcaattatgtaactatgtttgttggtaacagataagagcaattttattacatgaggttgttggtgcctggcaaatcttaggtcccaaaaattgttggcttttttcgtatccattgccctataaaataataaactataacctataaggatgaaagttttagccatttactttttataaagccatttcataagtcttcgtgagttaataaatatgttttttttccatatgagattaataaggctttgaacaagctggagcagtatgtcatgttttgacatcccttctctcttcttccagacaaaatattaaaacaagataaccaaaaagacacaactagggtaggaattttttaaaaatctctataggtcagaaaataaaaccacatgaagcattgagggtagtgctagaggcctgccagttttaggggccatttggctcctgagaagaactgttaataaaagtattaataaggaagaggacacacaaaacacgctcaatgggaaaagccaggcgtgcagctgacctggccctggcctaggacaatgtttacaaggattgaccactgtcaagtcacagagtcacaaattgtctagaatcaatattatgtagactatgttttttaaacctcaatgcaactaaatttaaacttataataaaaaagttagtttcaaaaaacatgtcttgccctaccagctattaaaacatactactaaagttgtacttttgtacatattgtacatactaaataatgtttatatacacatatatacatgtatataacttacacgtttacatagtataaacataaaggcagtactgccgtactagtataagaatagttagattaataaaataaaaaatctggaaataacaaaatgtcagaatttattctatgataaagatgaggggaaagatacacagttagcatatggaagaagataaaattagatccattcatcccatacaacagaaaaaattgcagtggatcagatttgagttgccaagtaaatgagaactatagttttttaattaaaatgggtgaatttctctgtagtttgaaagtgaggaaatgtaattcagatttttaaaaagattgacaaatttgagtaaagaataagctttttttttttttttttagacaagagtcttgcactttttgcccaggctggagtgcaatgatgcaatctcagcgtgctgcaacctctgccccccgtgttcaagtgattatcgtgcctcagcctctggagtagctggcattacaggtgcctgccaccacgcccagctaatttttatatttttagtagagatagggtttcaccattttggtcaggctggtctcaaacttctgacctctagtgatccgtctgccttggcctcccaaagtgctgggattacaggcatgagccaccatgcctggctaagaataagttcttatgaaaaacaagcaaaaagatgacaatctgaggaaaattattggtaacttatatcacagacacagatttcttatccttagtgtatagattgtataataagacatagcaaaaataaaatcatactgagatactactcatctttcagatgggcagaaacccaaaattggcaagtccttgggggcaaaaaagcactcttacattactagtgaggatacatcaaagtacaactcctggggtggggcggtggtgtaaatttggcgatatctagcaaaattatttatgctttcaacattcaactaagcaatctcccgtatagacatctacccaaagatatagtagcagaaatacaaaattatgtatgagcatattctgtacagtactctttactaataatgaaaacctaataggaaattggttgaatagaatattaaccagctatgtcaataggaaaatgagggaaaatctctatatactgctttagagttatctcaggatatattgttacaaaggcaaaagcaaagtggaaggaagtatgcatagtatgctaccatatatcaaagaagaagggatgtgtgatgtgtatgtgtttgcttacatttttaagggtagaataaaggaaatactgatacagtttacctgttacctattggaggtaggaggaagcgggtgggaaataaagcaaatctctgaaattcaaagacagaatgtcataagtacacctgtatttcaggtggttggctaattatagaagaataatttcaggtgactttaaagcacagtgattttactttatgtacttaatggaatatcttaaggagataaaattgcaaagaaatctgaaacttgaatcattttagtgatcataatgttatttttagatgattgcgtatgtatagaggacaatacatattaatgttgttagaacccagtttttcagcatgagaaaaaacagttgttacaaaatcaaagtaaaaaccatgcatcctaaatctgaattggaaatatgcattttctgaaggagagtaccacctagaaacagttacaaaaaagcaacagaataataataggtaccccctagtacgcagagtaatgtctctaaataccatttcccactcaaagaaatcagggcttcttcaaaaaaggctgagtaaaatttggggcagggaatatactagatgaccttggaacatctttttgtgcctaaaagcaaacaaggaagtagaacaagcccattgtagccatagcaaaaagatccagcttgacctggtcaaatatggcacactttgaacattgatcagaataactgtgctggattaaaacacatcataaacatattttcaaatctgtgatttcataatgattttttttcccttcgctccaggtagcagagtatcagaattattattattttttttttttgagatggagtctcattctttcgcccaggctggagtgcagtggcgcggtcttggctcagtgcaacctctgtctgcctcctgggttcaagccattctcctgcctcagcctcctgagtagctggtaggtactacagtcacccgccaccacacctggctaatttttttttttttttttggtatttttagtagagatggggtttcaccatgttagcccggatggtcgtgatcttctgacctcgtgatccgcctgtctcggcctccccaagtgctgggattacaggcgtgagccactgcacctggccgatttttttttttttaaaccctcattggctaccttttggaggactctgggaccaactcatcatcctgaaagtgtacacaaaaagggaatgaatcaaacatttattctgtatcttacctgtacaaattatgtttcagagtaaccaaatacttaatatgggaaaattcttatttatagaacttcaaataatacatgggaaggaatgataccatcattttgtaacctctaatgaaataatgggtttaggtttaaaaaaatcagtggttgctaaaaaccattgggtgaaaataacctaaaatggatataataagtttaccacatctgcaccactgattcatccttatcatgaagacagtcatcttgtgccttctctcctcatgtagtgccaccaatgaagtattcttgccaaaaattgtgatcaggcctctatattcgaacttgtttacagcaaaccaagaaatggaaaagcatgctgcatagtactatggggatgcaatgagcaaagtccaggttgtagaagattctttgaggcaaatgacacagtttctttgacaaataaatgacaaagaaaaaaccaagggggaacctgtgtattaaaacagtggtcctcagagcgctggcatgaatcaaaagtcactgggagggcttgtcaaaacacagattgctggcttcatcccgtagtttctcattcattagccctgggttagggcccatgaatttgcatttctaaaacgctgctaggtgctcttcctcctgatgatccagaaaccacagaaccatgttattaaagaagtcttggattatgaatcaaatacaatgtatggaccttgtttggattctgttttgaacaagccaattgtaaaaataacaataattcccttgataatagggaaatgtagacatgggatggacttttgataatattaaggaattggtaaattttgatagtgtaatcatggtattgtaattatatttttctttttttaaagaaggccctgtctttttagaaatacatgttaaaattatgggtaaaatgctatattgtttgcttgaaaataattggcgctgaaaagtagttgaggatagaggtaaaagagattggccatgtattaacaattgggaagaaagcgagtgatgagtacacaaggattcattatctgtattaatttttctacttttctatgtttatggaaattaccttcaaaatgtaaaatatatgtttggaaacataaaaatatattccaaaatagctcatgaattaaatgtaagtcaccatagaaattacacgttttttggaatagaacagtcatgaattatactatttcaaaacatgtgggatgcaggtaaagcaggacttaagggtaagtttattgacttaagtcttccaaaaaaagatgtaaatgaattaagttcaattcaaaagttagaaaatgaaacacagaaaagctggagggaaaaagaacagaaaaaatagaaataagttaataatgcagtcatcttttattaacaggtagctgagaagattggattgaactaaggcattattctgagggaggttggtctgtaatattcctctctttaatatccttggttctgtctcggtgctgtgctagcctgatagaagaattgggcagtcttgagccaggtatgatgctcgcctgcagtctcagctgcttgagagacagacagtaggattgtttgaagccaggcatttgagaccagcctaggcaacatagtaagacagaaaaggggaaaaaaaaaaaaaaaggtgtgctaatgtaaagagaaattaaaagtaggacttctgttgtcttaaatagtttctgcctcagtgagtaactactcaacttatgtagaaatggctcagtattttttcagcgcacactttgtgccagatgctgtgctaggtattgaggacacatagatgactacgatatgacccatactcctgtggcactcagtctgagggagcatataaatttgtaagtaaaaaattagaatcaggcaataaatgtcagtagacaatatggaaaagttcccaggcaattccttgagagaagaaaattcttaatgtataggatgggcccagccttgtgaggttttgctcaagtagtctccaagaagaaatggcatttaccaagcagccagtctgttataatgggacacattaaaaatcacaaggagtttgctgtgtgactgggagaccattaagttataagagctgtcagtgtatgttatttaggatttttgtagcaaggtttatatgagagattggcctgtaattttcctttcttttaatatccttgtatggtatcaaggttatgctggccttataagtgttggaaagtattctttccttgttatgctctggaagaggctgtgtaagactggtattatttcttccttgaatgactgcaaagccattgggacctggggttttctttagtcaatgtgtactaaacatttagtagaaacagtgacccaaaatttcaacttaagttgaatatgtatctgaaaaggtttattattcttactaacattttcacataaaacttccctctgctcactgaggttaattcacagtttgatcagtgttgtatcagtgacagaaattcactagtataaaaacccagtccatttctaaccaccaaatggtgtattacagcttcaaaaaaaaatttttttttttttactacctaggctttgtgctgggggttaccatggtgtcaaatgagacaaatccatgtcatccagatacttgtggactcaatttgatatgagcaagcatcagatcattttaatctacttgctttattgggatgtgtatgtggatatattaagggctgattattttgatgggctttgctgtttggaatgctttgtcttaatttttgtggatgaatttttaatttatatatttcataagaagtaatgaatttgcatcattcacacttcagaagttataaataaggttctccacctttgtcctttagtcacccagtttcccatctctggagccaaaagatgttagttgcttcttagctattcatcaatttttatatcctctgaatatgcaatatattcacccccgctcccttcccccaccccgttttttttaaacactttctcttctgcaccttgcttttaatttagtaagtccttagaaactgttccttattgcatgttaaaactacgtcttgtttcttttctcttatgacttccttgtatcttgtgacaacagtaataataaattaatgtagtcattgtgatattgatggatttttaggttatttccagtcttcctgcccaaaaaagttacatcgaatatcccaaattgcttttgaataattaaatcatcattttatcttccttcactagttttttaggacagattttttttttcttttcatttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggttagaaaccagccttccacttttgggggtttgttttcttaaagttgggcagatttcattttaacatttattagttacagaggaatgttgtctttgtaaaactgagtgacacagaagcattctatccagccctgtccttgtcttagttttgtgactgtgaatggcctttgatcaagttacaagggatgtgacttggaaacctgtatcatgaagagctgttttggtcatggtcattgcaattgagcaaaaattgaaggaagcaaggatgctttctctaatgtacatggaattgtggattgctgtttttctgaggatttcactaaaggggaaattctagaacatcactcaggagaaaacatcctttattaataacttacgtggcgggatacaccaatatgacatttctcaaatgacaaatatacttcggtattaccgaatctaagaattttcattgaaaacaaaataaatgttacctttggccaggtgcggtggctcatgcctgtaatcccagcactttgggaggccagggtgggcagatcacttgaggccagttcaagacaagcctggccaacttagcgaaaccccatctctactaaaaataaaaaaattagccaagcgtggtggcacacacctgtaatctcaacttctcaggaggctgaggcacaagaatcacttgagcttcggaggcagaggttcggtgagccaagattgtgccaccgcactcaagcctgggtgacagagtgagattctgtctcaaaaacaaaaagttatcttcaagtttagaagatgccagtgtgctttaaaattacctgcttatggatgtttttttattttggggaaagtaggacatagtagagagctttgaagccctttaatcaccaattccatcagctttcttccagaaggtactgttggtttttatgttcctaatatatataattaatctcaacattaatttttactttatcttatttcagagtggttaaatctactaagttcagatattggagataaggtcttttgttaagtagcgtagatatttttaaatttccatataaaatttttttgaatagataatagaaaaatggtatactagtgatagatgtacagaggtgaaagtacactcaaaataagatcttttccctgtttttctagttctctcctatggggcctaaataactatgagtttcttaggttttttgttttttgttaatttttccagagatactctgtttacatacataaaatacatgtatctgtgccattttttccctagctaaatcacagcatgctaagtatagacatttaaaaatcgtcatactcggccaggcatggtggctcatgcctctaatcccaacactttgggaggccgaggcaggaggtttgcttgagcccaggagttcgaaaccagcctgggcaacatggcgagactctgtctcttaaaaaaaaaaaaagctctacatttctgttaccaggaaggaggcacctaaaggtctgttttttgttttttgggttttttttagggctgtattttaaaagtatctcttgagtgtcagtgaaaatatgtgaactcagtactacctgaactctgatttggggtttgaggaattggtacttcaggagttaaattaagccatggcatctgagacaggctcacgttgaaactgtgctttgtcggtaatctgtccatacaattctagtgtgattggcatcaaaggtaaaccctgatagaaggagtaagacagtatgtgccaacatacgatgtcaggaacttgttggggctcagaaaatgatactccaaaatatggttctttgacaaactaaggaagcagcctcaagttctatgccaaagcacaggatgaggctgttccttgaagttcctttatctgcctagaaaccagacccaccaaaaggaatacaattgcctttgatcccctcctcaaaatttcattaaccagagaagcctgaaacttgtatgacagaggaaaagactaaaaattaaatatcacacctagagagctcagaggaactttgcccagactattgtctgttctcagatcccattcagtttccaaagagaattatttactaaccattgtctgtgtactgggcccattcattcttcctaaaaatcatttactgcccttcaaaatggcgtcatttccctcatgtccccttcccctgtgaagaagggtattatatagtatctggaactcacttggttattgggtaataattgtcttgcaatttcccccatgcttatgcaccttaaataaatttgtttgccattttctcctgttaatttgtctattatcagttcattttcagcgaacctttagagggtagaggggaagttttccttttggcccctataaagtgatcttgaaagaaatgtttctttatctgacataaaaaaggatggagaaaggaagcattattgtacctctgactttctaacaaattaccataaaggaagaatatttttcgtctactattgttagaacaccttagaaccatcaaaaatataattacatggctaatagaaaaaaaaagagcagttttaaaatatgttttatgtaacctattttcattgtttttcattttgttgttgccgagtagtagttgttctaagtaaatacaggtctcaatttcactatgaataaaaactgtcaaaatcaagaaactaaaaaaaaagttctttaattactaatgtcaaaaccatactgtttttaagataatttgtaaagtctagaaatggggccattcgccattttgttttatgccatagatcatcctggggttttttggtgggcaaatgctgctatttgtaaaactcttccttccaaagattttcctaaatctttattctcaaacttactctgggtgatgggtcctggacagaatagcttcacttcctttaaaggtaacttctttgtttcatctttactgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacgtgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggtaggctcttatctgatgttttagcactggaaaaaaaaaaaaaaagatattaaattaggaaagagaaacttacattccagggtcctgtccttattggacattagcccagagaataactttgagccatctttctaccaagatactcaggttaacattgcccttccaagaaagtctacacagtctgctccctccctgctcctcctagggagtttctgtttattttgattccatggaggtcttttttattctatatttaaatgtattgtgtctcagttgtacatcctatcagctaggtatgcctaatttttatttgaatagcttaaaatagtatgtgtaatgatttaaaggaattaataaattgaacagtaacaaaagcagtatttacttggataggctactttaggaaattttagagtcatgatactatgaggaagagaaaaattctttctagtggacattccaaaggaaaaatatcaaaattatcaggagagtatctgcctggatagtgtttcaggttttcttgttggcttttatcagcattctctgatgaaccccagggagccctggttgtgaaggcatcttatttagaaggaaagattgtggccaatttttcttctaacacaggcacttgtctgactcgtgggaagaatctcgttcttaaaaccaaaaagattttaggtgtttgaggtccacaagattagaagaaattcggagccagaggatcattctacttctcttggggcagaagcaaccatataatgcctcaccttctatgtaacttactctgcactatgctaaataagtacattgttttagaatctgctgtagaagtaggagttggcaaaattctactcattttggatactgttaagttgtccgttggagcaccatgatgataaaagtcagatacagtcttcatagaaaccagttaattttgtgagagggaaaatctctattcttctttatctatctcataaatgccaccattaatcaaaagaccaagcaagggataactcaataataagccatcttcaccaaagttgagcatagacattcttatgatgagggggcactaatataccatttgactgtgaagtgcaggatagcattgggtctttataacgtgaagccatttttttctttgccatttctctgaagtgtttgttttgttttgtctttttgtttttgttttttgtttttgtttttgagatggagtttcgctctgttgccgaggctggagtgcagtggtgtgatctcggctcactgcaagctccgccttccgggttcacaccattctcctgcctcagcctcccaagtagctgggactacaggcgcccgccaccatgcccagctaattctttttgaattttttagtagagacggggtttcacagtgttagccaggatggtctcgatctcctgacctcgtgatccgcccacctcagcctcccaaattgctgggattacaggcgtgagccaccacgtctggcctgaagtgtttctgaaagaagaattttattcatgataaatgaaatagaaactaatataggagcagaaattaactcaaaggagatttggattcaggtaaaaagtcctccatgccaaaaaaatgttgaaattgtttccttttttcccaaggtcttataccctgaatctgataaataagtcaaattcttcttgatctttgtttcatacttgaatagaaaagtaaatctttactgttattaaaattatcaggaattcttagattttttaaaatagtaaagttttagaaaaggtgaggcttattagtagtaaagcttctaagatacgaagattagaggtaattactcagatttgcccagaccagagcaaaaaacttgaaagaggtttttaaaaatcttctttgcatatgctggagattaaaatattggtttgttatatatgctttagttgtcagtgtttaatatttacctggcataattgtggaaagttatcagtaaatgtatgaaattcaagtatagggttatatttgaaatagatcaagaaatctggtggtatttgtatcaagaaagcatgtgtatatttttctcatcctattattttctaaataaccttaaggtagatgtcaggaaatagatcacaaagaagagtcatgtcttttcttctttttttttttgagatggagtcttgctctgtcacccaggctggagtgcagtggcgcaatctcagctcactgcaacctccacctcccaggttcaagcaattctcctgcctcagcctcctgagtggctgtgattacaggtgcctgccactacgcccagctaattttttgtgtttttagtagagacggggtttcaccatgttatccaggatggtctccacctcctgacctcatgattcgcctgcctcggcctcccaaagcactggtattacaggcgtgagccaccgcgcccagccagaagagtcatatcttaagtgaagatggctttaaatagtgtttctcagaataatcaagaaagctagaaaggacttttcagccccaaagaacagagggtataaagacatcactcagtatctgaacactagacgctgttgtaaagttactgggtttttaacttatactttgtaatagatattaatgcagctgagttagcaagcaatagtgagatcagtgtcattttctaatcgtatacctcatatgctgtgggatgtggaaagccactaaacttcaaaatgcttatgaattactacagaagctgtctttaagtacttcctataggatttaacatatcatgtggctgttgtagggtgctgtgctcgtgtacactaacgtcagtatgggtgaggttaatgaaaaattccaagatccatggcccaagtgatattgaaatgtaaaattttgaaaaaactttaaaggcatttatatatcttcttagttaaatatggaaattatcaccttaatttattatactatgttggcaggattttggaaaaattcatccttacagagcttaactttttatttttatttttatttttatttttatttttattttgagacggagttttgcccttgtcgcccaggttggagtgcaatggcatgatctctgctcaccgcaacctctgcctcccgggttcaaatgattctgcctcagcctcccaagtagctgggattacaggcattcgccaccatgcccggctaattttgtgtttttggtagagacagggtttctccatgttggtcagcctggtcttgaactcccaacctcaggtgatctgcccacctcgtcctcccaaagttctgggattacaggcatgagccaccacaccctgccaaagagcttaacattttaatttcattttggttacttatgatttttatgtttcaaaagcaatttccattctcagaagaaactttctgaaactgtaaacatctttgctttgtgagattgagcagttaatgctattttctagtcatatctctgttacacatcagtgctcacttgtaaattggagagaccttttgagcaagtgggtttaggaatgcactctagcttctgttttaaggtcttttgagagaagaactttgaggaaagatagtcccccctgaggtgcgaacacttctaccttctcttgtgcttaagaatatggttcttggactgggggcggtggctcacgcttgtaatcccagcactttgggaggccaaggcgggtggatcacctgaagtcaggagtttgagaccagcctggtcaacatggtgaaacccgtctctactaaaaatacggaaattagctggatgtggtggggcgggcgcctttaatcccagctgctcaggaggctgaggagggagaatcgcctgaacctgggaggcagaggttgcagtgagccaagatcgtggcattgcactccagcctggcgaaaagagcaaaactccgtcttgaaaaaaagaaaaagaatttggttcttaatatctggggttccctagtacctatgagatcgagtttaaactctgcaactggctcatggtctgtggtcagtagccttttcactcactggttccagttaagccagtaactcttccattattagctaagtgtactccactgccttgttgctgttattctgctcacaagcttttccccatagtgagaaccttgcttatcccctttcttaccagtaaagattcttcatttctgttttaaggcttagggtgagattcattcccaagtgcccttatgagaattcttgaggcagggcacagtggctcacgcctgtaatcccagcactttgagaggccgaggcaggcaaatgacctgaggtcagaagtccgagacctgcctggccaatatggtgaaagtccatctctactaaaaacggaaaaattagctgggcttggtggcatgcacctgtagtcccagctactcaggaggctgaggtgggaggatggcctgagtctgggaggcagcggttcagtgagctgagatcatgccactacactccagcctgggtgacagagtgagactctgcctcaaaaaaagaaaattagagaattcttgaaactacccagaaataaaaacaacactgctgtataaagatgtcttaactcagtagccagtataattccaatttaggtggtcaaaagtatgatatggggttactttcatttctgggcaagtaattgcttcaatctgtatagaaattacagtataaatatttggcaactactgaataatgtgtagttgccattccttataggtggtaatgaatagacaccaaggtcagtccctggtttaatgaataataaagcccacagtattgctgatgaggatattatactgcaccattacctctcaacagtgaagaggttcagatgttcacagttgtagttaatgagaacaaaataataccattgttcagagctatatgaaaacaattgccaacaaccatttttttcctgaatttagtaaaagtaaagtatttggcttttttcccttcaaactgtctttcatgttagctgtttcaaaatcctgttaacacttgtctaacgttatctttctcttcgaagttctgatattaaataaatcatagatttatttgaaggttttccaatgaatatattatattttatttttaatgggtacattgaaaactttatataagagggaagatttagtctcacacctcacatacttttaactggttatttcatttgttttattaaacttgcctcttccttgttatttgaacagtgccataataactttgagaccatgattgagtaatacagattacaaaaggcctaattccagaagtctatcagaaagaatgtagaatcctaggataatgctagggaacaccaacctgccatcctgttttggatgtgatttttcagagtttaagattatcatctagttctcataactgtcccccaatccatgtgtatactttttttaatcaaaaaagttgttctaaagttaaaactgctttggtaaatggcataaacattaaaaaacataaagcattggctcagtgttttaatgactttagaaataataaaatgttttattacagtttaaagctgtgttggaaaatagggtatggcaagacctctatcttaaacagttggaagaaatggcatttttttctatttttagaattgttgacataaactgctatcactaaggcaaactacttacaagacatatatttttagagttattctccatttctaaatttggatttccagttcactaagttaatcttccttaaacaaattgattaccaccctccctgcaaaaaccccttgctcctgtgccatatattatcgaaaaaagacacacttttatataatgcagtatttactaaagacagaattgctttaagaaagtaacactgactaggtagttagctccccaaatcattaattcttatgttattttatttatttaagatggagtttcactcatcacccaggctggagtgcaatggcacgatctcggctcactgcaacctcctcctcgtgggttccaagagcttctcctgcctcaacctcccaagtagttgggattagaggcgcacaccaccacccccagctaattttttttgtatatttagtagagacagggtttcaccatgttggtcaggctggtctcgaactcctgacctcaggtgatccacctgccttggcctcccaaagtgttgggattacagtcatgagccactgcgcctggcctgttaatatttttatatgcaacgaacatagtatgtttcattgggttcagtaaggaagataaaatagtgttgctatttaagggaattagtagacatgggatagggaaattgcatatatttatataagaaaacaggccagcctttttctccctttcttaacaatatgatatgtctttgtggttcagtctagccaaaaaacaacaacctctgcctcccatacaagcgcgcgtgctagcgtgaacacactcagataacaaaggtttcaggaggcagaagtgaaatggaaatttcggaaagtatcctactccatgctttacctagtcagattatgaaggagaatgaccatgaagttagacaaatgaaagagttttctcctataaggtgtcctgcttctggggaggaacagttaaatcatgtgtttccatcgtgagtaagttttataattccttgtattcttagcaaaggattgtaaatgtgaaagtgaagttaccataggaaactaagaattttagatgtaaaatagtgaaaatttgtttcagggttatctagacattttgctactttaaaaaaaaatcttaatatgggtaagcatgaagtcaaattaatccgaatgtttaatcaaaaatatattttatataaattctccattatattacatttaaaaataagcctgtatatgtcttatacctgtgttaaaaaatgccaattatatttcaataatgtaattttatcaaaacacattttcagtgaatatcaacattatttcataattgggtaaatctggcatagctcttttgtagacagtccaattatgtcctgagccataagccttgggacataattggattgtctacaaaactgatttcagttgaaacatttcatgttgaaagttacgtctatctctaagaagtttttggattattttatcctgaacacaatgcctaaaattagaatactggactaaaaatacaagtttgttaaacttctgttttcccaaaggtaactaggataaatagtttgacagactttcaaaactggggaaataagttacaggaaatttagccaaaacataatcatgcttctgttctgtatttcaaaggtcaaatagtttttttctaactgaagcaagtatttttagccattttcttctgtaataatacaaaaatgtggtagcttttcccattgagcttgtaaatcttagctaatgtgggacacatttggagtcagagctatctacgctgtaagtaaaactaagggtcccagtttgttctggaggaaactttgcagggtggttcataaaagaaaacatgagtttgcctgctttatttagtggacttttatggaaccaagacctagccataagccattggcccttcttactacatttctctcctctcatgtaaatagcaatataatttcccagaagtcaaaaaagatgctaagattatgtagttttgaaagttaaggtatgttggccttacataaaatgatgccttagtccacatcatttagaaaaataatgagaaaggcagtaaaagtagtcagaagtctggaaacacttagaatatttttaaggtttttttaaatttttagagtatccaagagaaacgaaagcatgtttctacacaaagccaaaatgtagaaataacccaaatgcctatcaacagatgaataaacaaatgtaatatattcctacagtggaatactagttagcaataaaaaggaatgaactgtggatataacatgaatgaatcccaagattatcacactaagtgaaaaagtacatgctgtatgattttattttagaaaattctagaaaataccgaataatctacaatgacaaaaagcagatgattagcttctgaaggttgaagtaggggaggtgagaagtagtgggagaaaattttgaggatgattatcttttttttttgagatggaggttcgttcttattgcccaggttggagtgcaatggcgcaatctcagctaccagaacctctgcctcccgggttcaagcgattctcctgccccagcctcccaagtcctcccgagtagcttgaattacaggcacctgccatcacacccagctaattttttgtatttttagtagagacggggtttctccatgttggtcaggctggtctcgaactcccaacctcaggtgatctgcccacctcaccctcccaaagtgctgggattacaggtgtgagccactgcacccggctgaggatgattatcttgattgtagtggcagcttcacaggtgtacacacatgtcaaaactcatcaatttatgcactttataatttattgtatatccgttatatatcaaaaagcttttcaaaatttacttggaatatctaatcacctgtaactaaaagtttcaaaactcagctgagtatttatacctttagtatgctatccataatctgcatatatgttatttgtatcattggccttgttacattagagtcatcccttgggggattggttccagcaagtcccttatataaaatggcatgctatttgcatataacctacacacatcctcctgtataccttaaatcatttctagattacttataatacaatggaaatgctatgtaaagagctgttacactgttataactgtgttgtcattctgtattgggaataatggcaagaaaaatagtctatatatgttaagtacagacacagccttccatttttcttctcgaatatttcgatccatacttggttgccttacggatatgaaaggctaactatatttgttttcatgccaaattcttccctatttgattaataatacactcctgccaccagtaagtaaagtgtctttttttcattgattctttcaagtctaatttaggtgaatccttaggttagttactgttagtcatggctcaaatataggtttaatgagaagagtgtttccatagcccttcaaggggtcggatatctccttaggtaacttggaatgatttccctgcttactgacatctctaagttatctttctttataaatctgcatagttggttctgcagtgtctgctgacatagaaattcagttgttaaatgaagtaaaaagtaaaaatttcacggcttttaacaaacatagtggccaaattcaaagcagcaagaacatggagagtctagtctgcacatgatactagttttaacctaataaaaagtaggaattttatttaaaaggctaaaataaaaagttgtaaaaataatatgaaaattatagccaattcagttattttagttatgacttacagtttagtgttatatatttgttttgtgctacaaacaggagcataccttctttgataaaaagcaaatgagagtctttagaatattctccaatactcccatgtttgtcacagaaccctaggcatcagccttttctggagtctataattttattcattttaaagtttattgttaaatacatcctcatattttaagagcaaaataaattcttcaaggaattttaagttgttttatgctccagagtaattcattcactctggccttagggggtacagcaaaaataattacgatattttgtgataagtgctgtgttcaggatgttaaagacatgacatgtctgtgtctaatccaatctcaagatcgagatgggatcaccacggagagtttcttcaaaaaggtagtgccttcaccaggtcttaaataatacggaagaaaggcatggtattgagaggatgtgtcctcccacagacagactacaatgagtgtagtatcactgttttaaagtcacttctcactttgtaagatgagcatgggaggagtcaaaagtagaagatagaaaagaaataagagggatccccataagactgcaagaaaagttaaaaagatgatgagtataaatgaagttacttttgaggcaagcaggaagaggtggcaagaggggccagaaaaatcaaagattatacctgatgacctggttttttttgtttgttttgttttttgttttttgttttgagacagagtctcgctctgtcacctaggctggagtgcagtggcgcaatctcagctcactgcaacctcagcttcctgagtagctgggactacaggcatacgccaccacgcctggctaatttttttatattttcagtagagacggggtttcaccatgttggtcaggctggtctccaactcctgacctcaaatgatccgcccacctcagcctcccaaagtgctgggattacaggcgtgagccaccacacccagccaatggcctcagtgttctaatgtagatggaaaagaaatagacatggacttcactggctgggcatggtggctcacgcctgtaatcctaacactttgggaggccaatcgcttgagctcaggtgttaagaccagcctgggcgacatatagtgagaccttgtctctacaaaaaaatttggaggaagagaaaagaaaagaaatggacttccctgaataggggcttgagatagtatgccatatttggagtagtgaccatgaggatgtgaaaaacaactgaccaagaacaaaacaaaacaaaaaaaccaataagtggtactagggtccatccaaaaccaaagacctttaatttgtaatgataacattctggatagttatgtgatttcttttttttcttttcccttagcatttctcagcaatctcagaatgaaaatggaacaaatacactttggcattgctttggggttgggatttgctgggctgagataaaattatatgtacatcaggaatctaaaaggtgcttatgctgttttgaatgatcagtcatgaatttaagcttgtagggaaggagaaaaaaaaataagataccaaaagacagccaatagactagactagtaaggagagatgggtctggagtctctgaggttggagggctggtagagtggacatgagtctatgcaggaactggttagaaaaaaatgtgagaaagtaaaataagtgcatgtaagattttggggagagaagtttctaagccagttcttgggtatgactgagggaattaatgattgaaatacagtgatgaagtggtcagtatcatttcggtgtaaaggcgatcccggcatttcaacaatgggttattatatgggttttatgcatggaggtcataattccaatgtgatgaatgcagttggaatgaagagaaacactgatcatcgtctcaaaacatgacttaagattttagagttggtttggtttcaaataacaggatcttagtggctgtgcaatgggtgtttgagtggagtggagatgaaggtcactggaatccagaaggttcaggaagctgtcaggttaagtgaattgtccatttaatactgaagcatgttaagaggcatggagaatacttggagtggcaagaggctttgaccagactccagaattttcccgtatataagatggagtaacgaagagatcagtaaatttgagtacaagaagcagtttaccttgcagggaagacaggcaaacaattttggcatttggccaagtccctaggttccctctcaggacattggtgtttgtttttttttaaagtacaggattgaaaagaaaaggaatttcattgatacagttaagaaaatattaaatagaaacttgtgatataacgtgcttctttttaatgtataaataacaagatctaaggctgggtgcagtggcctatgcttgtaatgccagcactttgggcggccaaggagggtagatcatctgagcctgggagattgagaccagctgggcaacatggcaaaaccctgtctctacaaaaatacaaaaaattagctgggtatggtggtgtgcctctgtggctgcagctactcatgaggctgaggcaggaggatcacttgagcctagaaggtcaaggctgcagtgagctataattgcatcactgcattccagattgggtgacagagtgagaccctgtctcaaaaagattaaaaaaaaaaaaaatctagaagcacatcttataacgtaactactgtagcattgaaatagcaatgatcataaatggtattttaaaatatttgcaacaactacaatgtgatatgaaaacatttatatgttctattggtgaaaagttaggtacagtgaatactaatggtgcatactacattggagaaaatgttgacaaatttagcgaaagttaatgtgtaatttttttttttttaccccattgaagttcagagactctctgaattctgtcatggtccgctggttaagaaactctggtttaaaggatggtatatccagaaggcataaacctaaagaaaaataagtggtatttgcatgcaggagaattgtagtttagaagtggcagcgtagagctaggagaagctttccatacttcaggaccccatggcgattgtggaggtgagggctggagatggtggggccgtgcctcagtgagcagacttggctcagaaagctgtgtggaaggatgacggagtcaggccagtatcctttgtgataagaaactgtatgtatttcaaatcaaacccaaaaagtagagggaaagaaagctgatggtctagtagagatgatgtttacgataggtggagaggcacagtgaaaattcttaggagggtaagaaacagtgaacagataaaggagagaaaaaggacagagtagtaatgagtgtgctacggatgggtcacagtgagatgaactgtttttgaggtcctgggcaaatacaggctgaaacctgggaggtttggaagcccttgaaggcaggccttctgcaaccatcagagtagcaacctacagcctttgctcaggtttacagggagaatcctgctgagaaattgttggatgaccctgaagaaattttaccccattttaaatattatgtttgtggtggagaagccttgggtttgtgttttaacttctgatgtctttttttcattttcctcctctctccctgctagaggatggaacatattctatccagctcaggatagaaaaacctaaagtcaaaatgagacatttaatagcaaagtgtgaaatagtgttgggggttggggaaggattggtgtcttatagtaaaatcatcagatgctattcttcctacttctttttttttggcgggggagggggtcggggggttccaaacacacaaaaccatataagagttgtcgagtaaaagcaaactttaagaattatttttttagggccgggcgcggtggctcacgtctgtaatcccagcacttttggggggccaaggcgggtggatcacgaggtcaagagatcgagaccatcctgggtaacatggtgaaaccccgtctctactaaaaaaaatacaaaaaattagctgggcgtggtggtgcgtgcctgtagtcccagctactcgggaggctgaggcaggagaatcacttgaacccaggaggcggaggttgcagtgagccaagattgcaccactgcactccagcctggtgacagagtgagactccgtcttgaagaacaaaaaaaaaaaaaaaaaaagaagaatttttttttaaagaccagacttgccattctataataacccaaaggaggatttgggagtatcttccagagtaaggaaaataacaaaaagaaaacaaagtagcaaaatgtatatagggtggggggtggttaatatgactagacagactttaaatatatgtaacttaatttttagtcatttgaaatggatagaattaggtcattctgattgggaaatgtattaactttaaagtagatgtttttaatctatctgcacggttactctgatgaacgttttatttctttaaacctaacattaaatgtgttaatcagtagattgattctctttggctttatttttaattaggagttagccctgcgtagccagttaccaacactggagcaggatggtgggactcaaaatccagtgtcttctcccgggatgtctcaggaattgagaacaatgacgaccaatagctcagatcctttccttaacaggttggtgaaagttgctactggtgaatatctgaaaaggatcattgctttaaaatcattctgcttagtgcttgtaataggctatttggaacatctgtgtgggccaaaaaccatagctgtaaatgaatctctctgtaaatggcaagtacatgcagagttgaggattaaaagttgtctcctgtgagaggaagtgaactgttcagacttgtacaagggatacttattcaaagtcatgacgtgtttgcttctgcctatactgttgactaacagttacttaaaattacagaatcatgaaggaacatgtgaatgcctttctgtgaaagcaaatgaatttcatgttaaacctacttaggattgcattataaggatcactggaaggaattttccacatagctattcaagctaaaacgtttcacccagcagcactgtaaggcctcatgttcttaagggctatagtccaaggagataaaatgtaaggttgtgcctctttcaaaaatgcactaagattaacggcagtatttgaaaataacatagcttagggatgcttcttagtgagttaccacaaatcctgggtttcagacagattgcaatattacataaactgccattttgaagtctgtaagctgaaacaggtcatattctttgcctaggaagtcatttaagattaagatttaactaaaattccttcttctaggttgtggagtttcaaactttttaaaatatgggattagtttacgctttggattccttttctaactgatttaaataacacactttcttaaatactcaaaggtattttgcactaggaaaactattacaccaccttttcagttctcaccaattgaattggaaacttagtaattccaagagaaaatatcttatcctgctaaaagtatttagtgcaatagaattcaccatttactcagtttttaagattagtactggtggcctagttggaaggtttgattttgaagaccatctaaaatgtattttaagtttgtatttactcttctgacatacactttaaagttctaaaagtaagtgtatttatataagattatagttctagacttaaactgaggctaattaagagaggcatagcctcagaactttttttccaacaaggaaaatttcatatccatgtaattccagtacctgtcttgttgaaggggctatattaatcccagggataaaaattagaccattttaaaaatggataggctgcatatccttctgacagtcacttatgaagattttttttcttaaaacttttgatgagagctgggctacaatttgagattctattttctgggaagatcagagtggcagataatcagtgttactaatctaagggcagaattgtatatgcattctctgcagtacccccagtttctaataataacatacatctgactttgactttttttttctttaaaaaaaaaaacaactcttggctgggcatgatggctcatgcctgtaatcccagcactttgggaggccaaggcaagtggaccaccacctggggtaagagttcgagaccagcctgaccaacatggcgaaaccccatctttactaaaaatacaaaattagttgggcatggtcacgcatgcctataatcccagctactcgggaggctgaggcaggagaatcgcttgaacccgggaggcagaggttgcggtgagccgagatcatgccgttgcactccagcctgggcaacaagagtgaaacttggtctcaaaaaacaaaaagacaaacaaaaaaacctcttgatggtttttcccttgtttactatttgatttatgtatattccttaagctctaaatactttttgccccaacttgccttggcattgactcttagtagtaatgctgagttcccttagttcccttttacttttaccctcaaagctcactcagatgtccccctccatgaaacttttaccctttacttctaagctccctgtttgttctgaaagcactgtgcttacatctgagttcatatagcccctaaatatgattcattagtatatttgttcatttccctccttgaagttgtgagcctctcacaaaacattgtttgtaggtggtggtgattgttaacctctttatcctcaaagcctagtctaatgcctgtcatgtagtagcagatgctcagtgaatgtttactgaatgagtggggcctgtaggaagtggggttctgcagggagcagttcctcaccaggaaaatggccctgtaaactctgtcctcaggaatgcccatgtgcttcccctgtggtttggaatgaactctgcgcaactctgtaagttcagttattcagtaatagactaaaatgtctgatgtgtgtcccatgcttagcagccgaatagagtgatgactaggaccaggctcttgtcccagatcagggcaggcaaaatacaaacaaaccacatcctgaggccttctcatatatggctgcattgtataccaatggtctcagaggcaaatgtgtgttttcttggatctgtgtgaggcttttgagccttggcaaaatctggcagaagcattagagtaaaccagtgatggcagtatatagaatgaggggagagagagaacaaggcaaatgcattgcatcatttagggaaggcagttggggtattgactgagcttttagccttgagcaattgttaaacttgtttttattttttaacttttatgtaagttaaatagctgcttattaaatgtacaagccgtagagaaagttgaagttcacactcacacagaccattgaagaataacagctgccttgattttatgcgtttctctaagattttgtagagttagtagaactcagggaatgccagctgatgtctagatgctactagcttaggaaagtgttctatttctcagggtaatggatatttaccatacttttaatgtaaatctgggaaaccttacttagtctaaagtgaaaatctgtgttgggtcattttattttcaagggatgtgccttgcagttttttgttttgctcttttctttaactggagctatatgatttcccgtttcgtttcgtactgaagtgtttgaggctttttcctcccccgcccaaacacagaagcaaggagatcaagccacgagtattcttatcttattggcagtgactcacctattttggctcagtcctaaaaggaattctggtggtttatttggggttgatttttccttggcttatgttctctgcacaatagctaggaatttaacttgagtctagtgcagacctgtctcctcgcccacctggagtttgtgttgtgacgtctctgtgccaccaccacctggagaattgaggccttgggacaagtaagttgtatgggttcctccgcacccccagattcaaatgatattacagagaggagaatactgatgcagagaattttctgtcagccaggaaaactaactgggggtatctttttttgtcccttattgtcaccaagcacagaaccttaggagaaatcttggttccttagagctgccagcttcaattaggattaacttgtctatttcacttcatagcacaagccctgtctatggccctgagggagggtgcttgtttcagacattgcaggacaggaattttcactaatcctctttgagaattatgttgctgctcagcaggtgtttatttttaccttgaattgatttttaaaattttttgtgttggtctttaactgtcatgtttatgtagtggcacctatcactctcgagatgagagtacagacagtggactaagcatgagcagctacagtgtccctcgaaccccagatgacttcctgaacagtgtggatgagatggatacaggttggtattctttattcctcttagtaacctgacttaacagtgggatatgttatcaccaggtctcataaggtattgtaagcaaagatgattcagaagaaaaccaattaaaatcctgtaaatttgaattaaattgatcctgctttgtctctatacggtgatttgtaacttgtcttttcctagtttaaaaaaatatatatcatggattggccgggtgcagtggctcatgcctctaattccagcattttgggaggccaaagtgggtgtattgtttgagcccaggagttcaagaccagtctgggcaacatggtgaaaccccatctctataaaaaaacatacaaaaataagtcagctgtcatggtacatgcctgtagtcccagctactcaggaggctgaggtgggaggatggattgagccccggtgatcacaccactgcactccagtttgggtgacagaatgagacctcttctcaaaaaaaaaaaaaaaaaatcataaattggatatattagctctatttgaataaaactctgataacatgacttatgttagcatgttgatcttaattggcaggacaaactgacaaccctgttagaacatctctctccttatagattagtgtccttaattttgagagatgtctacatgtaattcagtgtttgtcttcatcttttctctaagagtttttggtccaccttaagtgttatggggctcaggaaaccaggtgggaaagactaggaggtggggctcacttactttgttagaatagttgcagaaggccaggtgcggtggcttaaacctgtaatcccagcactttgggaggccgaggtagccagatcacgtgaggtcataagttcaagaccagcctggccaacatggtgaaaccctgtctctactaaaaatataaaaattagccacatgtggtggtatgcacctgtaatcccagctactcgggagactgaggcaggagaatcatttgaacccgggaggcggaggttgcagtgagccaagatcacaccactgcactccagcctgggtgacagagcaagactccgtctcaaaaaaaaaaaaaaaaaaaaaaaaaaagaatagttgcaggggtcttgcaggagctaagaaatacctgcctcacaggggtaattacggaagcatttctcctgtggcttacctggcaaccattgccctagagttgacaactgccagagtgcatgaattggcagggaaatgaagctgttctttagctaccaactctttcactaactgcttctattctgaaagtgtttagcaaggcttttgtgcctgtattcatccagctcctggctttgatgctttctagaatccacactacccctcctctctgattatctagatgttaaatcatccttaggagccacttcaaacccatttcacacacaacacctttacttactcctctaatctgtattgctctcttctccagacccctgtagcacttaatggtttatgttagtttttctgaaagtatgttctattgaagctctgaggagtgttaatgttgtcatatgcaaaaaaggctctgtggccaagtaagtttgggaaacctagaagcaaggctaggaagatggatttattcaaagccctctgggaaggcttgttttgctgttaggaaggtgcatctcctaagggtagaataaagtattcttgcagtctttctattttagtgtttcccaaagtatatttaaggccaaggtaggtctataccactcatgtttatgtttagtcttattatggtggtgcttatctggaagacagggtagtgatgctgtcgtgttgtgtacttgttctttctcccgctgctgcatataatttttcaagggcttttttatttttttcatgactcctttagtgctcagcacataatagcaatcaagctgttattggatatctgaacaatgttgaagcaaaagtaaacttggcattgttattttgttatctgtgagttgtttgacctgatataaattctaggtatcagtttaggtcagtcaggagcgcttttctttccctgtgcatttctctgtgctcatatgatacagccctgatgttagcttttcaaaaaggactttgttatctctgtgtgtttccactaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttctttgttgtttttaacaattgatatttgaaactttttttttttttggcttcttactggtcttccaatagaacaagaactggcaataaaaggtgattacagtagtaactgggaagacaagttaaacttaagtttcgttgtgctttaagttaggcttgacatttggaacttttgaagtatggatatataattcttttaactttgtgttcttactcttcacatacaccatcctcatccgtggtagtgtctaagcagaactgcgtctgcttgattcttaaatgacttcactacatgtgacggcacagaggacactgagaacataagaacatggcactgtctttcagaatggcctttggttttacttctttaatatattctctcaggccaggcgtggtggctcacgcctgtaatcccagcactttgggaagccaaggcaggcggattacctgaggttgggagttcaagaccagcctgaccaacatggagaaaccccgtctctactaaaaatacaaaattagctgggcgtggtgtcgcatgcctgtaatcccagctactcgggaggctgagaatatatatatattctgttctattttggaggtcatgagagaatattatatattagtaaaaagcattacttactggcttataaataaaaacattcacaaattgaagtggtaggtcctgacctttgaataagaagtagatttgagtatctttaaagatggctggacgtggtggctcacgcctgtaatttcagcattgtgggcggaggctgaggcggacagatcacccgaggtcaggagttcgacagcagcctagtcaacatggtgaaaccccatctgtactaaaaatacaaaaattagctgggcatggtggtgcatgcttgcaatcccagctacttgagaggctgaggtgggaggatcacttgaacccgtaaggcagaggctgcggtaagccaagaccacgccactacactccagcctgcgtgacagagcgagactccatctcagaaaaaaaaaaaaaaaagattgatttctgtgtttgcgtgtataatagcttcaattattgacacatctattttggtgaggcaaatctgaaaatgcttcatattttacaatatataatttctttatgttagaacactaatttcgtgtagcttgaaattgattatttcctttttgtagttcagatatagtggtggtacatcttggctcaaaaccataccttgtgtctgtagacactgtgcttgttgctccacggtggtacactttttgtcagatggtgtgaagcccagtaatgtgaatctgccttcattctggatctctgaaccagaattgtaccatctttagttaactctgagtttaacagaatactcagaaaaatgtatttagatttgggaatagcctctaacgagaacaaggaggaacattccaaatacttgagaagtatagtagtcatacttaaaacatgatttacataatgtttttcttagaccccaaattaaagttcaacagctcagtaagtgaattgctcagctgcaataagcaagaaaacagtcttccagagggagggggagggggagagagatcagtaactactagtgaaaggaaacctaggtgactactgcagaagtgatcggtagactgggggttttgtttaattccccaaccccgatttccatttcttgacagctgaggttacaaaagaaaggcagccccaaggagctgatgatgttttcttaccttctctaatggcagccagactctccctgcttctgtaatcatcagttttactgacagaaaacctggctttattgcgggtaaattcctggctccggggttccacatgtgctaacgctgttggaatcaacagtagctctggcaggatgtctgccatgtcatccctattcaactttaaactgttggcacttagtcttttttagccatgagaactttgtgataaatcttttttgatttaaagcttaactactaaattaaaattcagatgagaagtcggtgacatttagtactacagtttttccaagtcacacataaaatatgttttgctaccttgaacacaaaaagctctgacataggtaaaatggataatttcttaaccataaacatagccttaatactgccacaaatgaaaacagttgcagaatcaagacatgagcaaaacaaaatgacactgaaaaggtattctgaattaaagtctgccgtattttaacaaaaaacaaaactcccaaagtgacctgacttacaagctgctatgatcctgttagaaacaaaaaacctagtatctttgccactgaaagcaattatttggagacctcttagcaaagggtctacttctgtaaaatttttgaacacctagtctagttaacttaaaaacaaactttaactgttaaagaaacaagaactagaggtactgtaactttgtgaaattggtattggtttgcactcagttagtggacagggcttgatttttttgtaaaaggaacttgtaaaaacttcttagggttgtgacatacctttccccacgtttccttacatcttgtcccaggtatatttttgtgg

SEQ ID NO: 3 - DNA, 5234 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 4 - DNA, 5396 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 5 - DNA, 5348 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 6 - DNA, 4993 bp, Homo sapiens
tttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 7 - DNA, 5282 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 8 - DNA, 5246 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 9 - DNA, 5294 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 10 - DNA, 5360 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 11 - DNA, 20 bp, Artificial sequence
  Primer
gggaagtgagcctgtttgga

SEQ ID NO: 12 - DNA, 26 bp, Artificial sequence
  Primer
actgttgaacaaactaaatgctgtga

SEQ ID NO: 13 - DNA, 26 bp, Artificial sequence
  Probe
atggatgccattccttttgcccagtt

SEQ ID NO: 14 - DNA, 21 bp, Artificial sequence
  Primer
acgaccaatagctcagatcct

SEQ ID NO: 15 - DNA, 22 bp, Artificial sequence
  Primer
cacctgtatccatctcatccac

SEQ ID NO: 16 - DNA, 26 bp, Artificial sequence
  Probe
tgtagctgctcatgcttagtccactg

SEQ ID NO: 17 - DNA, 19 bp, Artificial sequence
  Primer
gaaggtgaaggtcggagtc

SEQ ID NO: 18 - DNA, 20 bp, Artificial sequence
  Primer
gaagatggtgatgggatttc

SEQ ID NO: 19 - DNA, 20 bp, Artificial sequence
  Probe
caagcttcccgttctcagcc

SEQ ID NO: 20 - DNA, 25 bp, Artificial sequence
  Primer
cggactatgacttagttgcgttaca

SEQ ID NO: 21 - DNA, 21 bp, Artificial sequence
  Primer
gccatgccaatctcatcttgt

SEQ ID NO: 22 - DNA, 30 bp, Artificial sequence
  Probe
cctttcttgacaaaacctaacttgcgcaga

SEQ ID NO: 23 - DNA, 16 bp, Artificial sequence
  Synthetic oligonucleotide
ctccgagtccccgcgg

SEQ ID NO: 24 - DNA, 16 bp, Artificial sequence
  Synthetic oligonucleotide
gaaggagtcgggcagc

SEQ ID NO: 25 - DNA, 16 bp, Artificial sequence
  Synthetic oligonucleotide
cttgaagaaggagtcg

SEQ ID NO: 26 - DNA, 16 bp, Artificial sequence
  Synthetic oligonucleotide
cagtactggcctgtcg

SEQ ID NO: 27 - DNA, 16 bp, Artificial sequence
  Synthetic oligonucleotide
ctgcatcagtactggc

SEQ ID NO: 28 - DNA, 16 bp, Artificial sequence
  Synthetic oligonucleotide
cgaacatgctgtggag

SEQ ID NO: 29 - DNA, 16 bp, Artificial sequence
  Synthetic oligonucleotide
agtgtcccaggagaaa

SEQ ID NO: 30 - DNA, 16 bp, Artificial sequence
  Synthetic oligonucleotide
gtgatttaagaagtat

SEQ ID NO: 31 - DNA, 16 bp, Artificial sequence
  Synthetic oligonucleotide
tgccatgttgttgtct

SEQ ID NO: 32 - DNA, 16 bp, Artificial sequence
  Synthetic oligonucleotide
ccatccatcaggaaga

SEQ ID NO: 33 - DNA, 16 bp, Artificial sequence
  Synthetic oligonucleotide
atcctgagtcatggct

SEQ ID NO: 34 - DNA, 16 bp, Artificial sequence
  Synthetic oligonucleotide
tgttcttatggtttat

SEQ ID NO: 35 - DNA, 16 bp, Artificial sequence
  Synthetic oligonucleotide
tggcaaaacgagggtc

SEQ ID NO: 36 - DNA, 16 bp, Artificial sequence
  Synthetic oligonucleotide
ggttcatggcaaaacg

SEQ ID NO: 37 - DNA, 16 bp, Artificial sequence
  Synthetic oligonucleotide
cactggagcactctga

SEQ ID NO: 38 - DNA, 16 bp, Artificial sequence
  Synthetic oligonucleotide
catcctgctccagtgt

SEQ ID NO: 39 - DNA, 16 bp, Artificial sequence
  Synthetic oligonucleotide
ctcaattcctgagaca

SEQ ID NO: 40 - DNA, 16 bp, Artificial sequence
  Synthetic oligonucleotide
cattgttctcaattcc

SEQ ID NO: 41 - DNA, 16 bp, Artificial sequence
  Synthetic oligonucleotide
ataggtgccactgtta

SEQ ID NO: 42 - DNA, 16 bp, Artificial sequence
  Synthetic oligonucleotide
agagtgataggtgcca

SEQ ID NO: 43 - DNA, 16 bp, Artificial sequence
  Synthetic oligonucleotide
atctcgagagtgatag

SEQ ID NO: 44 - DNA, 16 bp, Artificial sequence
  Synthetic oligonucleotide
ctgtagctgctcatgc

SEQ ID NO: 45 - DNA, 16 bp, Artificial sequence
  Synthetic oligonucleotide
caaggtccacatttgt

SEQ ID NO: 46 - DNA, 16 bp, Artificial sequence
  Synthetic oligonucleotide
tagcttggtggcagcc

SEQ ID NO: 47 - DNA, 16 bp, Artificial sequence
  Synthetic oligonucleotide
tttatctagcttggtg

SEQ ID NO: 48 - DNA, 16 bp, Artificial sequence
  Synthetic oligonucleotide
agctttctttatctag

SEQ ID NO: 49 - DNA, 16 bp, Artificial sequence
  Synthetic oligonucleotide
accattattactcctg

SEQ ID NO: 50 - DNA, 16 bp, Artificial sequence
  Synthetic oligonucleotide
ttggaaaccattatta

SEQ ID NO: 51 - DNA, 16 bp, Artificial sequence
  Synthetic oligonucleotide
tactctttggaaacca

SEQ ID NO: 52 - DNA, 16 bp, Artificial sequence
  Synthetic oligonucleotide
attacttcatagctta

SEQ ID NO: 53 - DNA, 16 bp, Artificial sequence
  Synthetic oligonucleotide
ccaactattacttcat

SEQ ID NO: 54 - DNA, 16 bp, Artificial sequence
  Synthetic oligonucleotide
gtgctagctggtgcca

SEQ ID NO: 55 - DNA, 16 bp, Artificial sequence
  Synthetic oligonucleotide
cccttgaaaataaggg

SEQ ID NO: 56 - DNA, 16 bp, Artificial sequence
  Synthetic oligonucleotide
tatgaacccttgaaaa

SEQ ID NO: 57 - DNA, 16 bp, Artificial sequence
  Synthetic oligonucleotide
ccagacttaattcaag

SEQ ID NO: 58 - DNA, 16 bp, Artificial sequence
  Synthetic oligonucleotide
attggtttattgtaaa

SEQ ID NO: 59 - DNA, 16 bp, Artificial sequence
  Synthetic oligonucleotide
ctgtgctgggattgat

SEQ ID NO: 60 - DNA, 16 bp, Artificial sequence
  Synthetic oligonucleotide
tcctgacattttggag

SEQ ID NO: 61 - DNA, 16 bp, Artificial sequence
  Synthetic oligonucleotide
gagcgaaggtgcggag

SEQ ID NO: 62 - DNA, 16 bp, Artificial sequence
  Synthetic oligonucleotide
ggcctatgagtcaacc

SEQ ID NO: 63 - DNA, 16 bp, Artificial sequence
  Synthetic oligonucleotide
ttctttccactcaagt

SEQ ID NO: 64 - DNA, 16 bp, Artificial sequence
  Synthetic oligonucleotide
atcagtactggcctat

SEQ ID NO: 65 - DNA, 16 bp, Artificial sequence
  Synthetic oligonucleotide
acttactttaagaagt

SEQ ID NO: 66 - DNA, 16 bp, Artificial sequence
  Synthetic oligonucleotide
tgaaacctgatccttt

SEQ ID NO: 67 - DNA, 16 bp, Artificial sequence
  Synthetic oligonucleotide
taacaacctggtttgt

SEQ ID NO: 68 - DNA, 16 bp, Artificial sequence
  Synthetic oligonucleotide
ctattaagctgtttaa

SEQ ID NO: 69 - DNA, 16 bp, Artificial sequence
  Synthetic oligonucleotide
ctttgtaacttaaaag

SEQ ID NO: 70 - DNA, 16 bp, Artificial sequence
  Synthetic oligonucleotide
cttgaagaactatttc

SEQ ID NO: 71 - DNA, 16 bp, Artificial sequence
  Synthetic oligonucleotide
caactacttgaagaac

SEQ ID NO: 72 - DNA, 16 bp, Artificial sequence
  Synthetic oligonucleotide
gttgaccaactacttg

SEQ ID NO: 73 - DNA, 16 bp, Artificial sequence
  Synthetic oligonucleotide
aggaagttgttgacca

SEQ ID NO: 74 - DNA, 16 bp, Artificial sequence
  Synthetic oligonucleotide
agaaataggaagttgt

SEQ ID NO: 75 - DNA, 16 bp, Artificial sequence
  Synthetic oligonucleotide
aagttattcagcagct

SEQ ID NO: 76 - DNA, 16 bp, Artificial sequence
  Synthetic oligonucleotide
ctgccatttaagaaat

SEQ ID NO: 77 - DNA, 16 bp, Artificial sequence
  Synthetic oligonucleotide
cacacaactcagacag

SEQ ID NO: 78 - DNA, 16 bp, Artificial sequence
  Synthetic oligonucleotide
ggataaatgaattata

SEQ ID NO: 79 - DNA, 16 bp, Artificial sequence
  Synthetic oligonucleotide
aaggtaggataaatga

SEQ ID NO: 80 - DNA, 16 bp, Artificial sequence
  Synthetic oligonucleotide
aaaatcctgccaacat

SEQ ID NO: 81 - DNA, 16 bp, Artificial sequence
  Synthetic oligonucleotide
taccaaaacgagggtc

SEQ ID NO: 82 - DNA, 16 bp, Artificial sequence
  Synthetic oligonucleotide
gcattcacagagttaa

SEQ ID NO: 83 - DNA, 16 bp, Artificial sequence
  Synthetic oligonucleotide
gcctgtctggaataca

SEQ ID NO: 84 - DNA, 16 bp, Artificial sequence
  Synthetic oligonucleotide
gggccacaaaataaaa

SEQ ID NO: 85 - DNA, 16 bp, Artificial sequence
  Synthetic oligonucleotide
aaaaggtctggaacag

SEQ ID NO: 86 - DNA, 16 bp, Artificial sequence
  Synthetic oligonucleotide
ccagcagctaacagct

SEQ ID NO: 87 - DNA, 16 bp, Artificial sequence
  Synthetic oligonucleotide
ttctttggcagagata

SEQ ID NO: 88 - DNA, 16 bp, Artificial sequence
  Synthetic oligonucleotide
tcatggctgaaatgaa

SEQ ID NO: 89 - DNA, 16 bp, Artificial sequence
  Synthetic oligonucleotide
cccaagctacccaaga

SEQ ID NO: 90 - DNA, 16 bp, Artificial sequence
  Synthetic oligonucleotide
agaattcccaagctac

SEQ ID NO: 91 - DNA, 16 bp, Artificial sequence
  Synthetic oligonucleotide
tagcacagaattccca

SEQ ID NO: 92 - DNA, 16 bp, Artificial sequence
  Synthetic oligonucleotide
tcaccatagcacagaa

SEQ ID NO: 93 - DNA, 16 bp, Artificial sequence
  Synthetic oligonucleotide
ggctgtgtaggctgac

SEQ ID NO: 94 - DNA, 16 bp, Artificial sequence
  Synthetic oligonucleotide
attactttaagccaca

SEQ ID NO: 95 - DNA, 16 bp, Artificial sequence
  Synthetic oligonucleotide
gacggataaaaattac

SEQ ID NO: 96 - DNA, 16 bp, Artificial sequence
  Synthetic oligonucleotide
aaataagacggataaa

SEQ ID NO: 97 - DNA, 16 bp, Artificial sequence
  Synthetic oligonucleotide
agtaaaaaataagacg

SEQ ID NO: 98 - DNA, 16 bp, Artificial sequence
  Synthetic oligonucleotide
attgcctaagagtaaa

SEQ ID NO: 99 - DNA, 16 bp, Artificial sequence
  Synthetic oligonucleotide
gcctacctgacatttt

SEQ ID NO: 100 - DNA, 16 bp, Artificial sequence
  Synthetic oligonucleotide
ataagagcctacctga

SEQ ID NO: 101 - DNA, 16 bp, Artificial sequence
  Synthetic oligonucleotide
ggtctccgagtccccg

SEQ ID NO: 102 - DNA, 16 bp, Artificial sequence
  Synthetic oligonucleotide
aagaaggagtcgggca

SEQ ID NO: 103 - DNA, 16 bp, Artificial sequence
  Synthetic oligonucleotide
ggcttgaagaaggagt

SEQ ID NO: 104 - DNA, 16 bp, Artificial sequence
  Synthetic oligonucleotide
atcagtactggcctgt

SEQ ID NO: 105 - DNA, 16 bp, Artificial sequence
  Synthetic oligonucleotide
catgctgtggagtcag

SEQ ID NO: 106 - DNA, 16 bp, Artificial sequence
  Synthetic oligonucleotide
ctcgaacatgctgtgg

SEQ ID NO: 107 - DNA, 16 bp, Artificial sequence
  Synthetic oligonucleotide
gaccagaagatgtctt

SEQ ID NO: 108 - DNA, 16 bp, Artificial sequence
  Synthetic oligonucleotide
atgttgttgtctgatc

SEQ ID NO: 109 - DNA, 16 bp, Artificial sequence
  Synthetic oligonucleotide
gtcctgccatgttgtt

SEQ ID NO: 110 - DNA, 16 bp, Artificial sequence
  Synthetic oligonucleotide
tcccatccatcaggaa

SEQ ID NO: 111 - DNA, 16 bp, Artificial sequence
  Synthetic oligonucleotide
ccatcctgagtcatgg

SEQ ID NO: 112 - DNA, 16 bp, Artificial sequence
  Synthetic oligonucleotide
tcttgttcttatggtt

SEQ ID NO: 113 - DNA, 16 bp, Artificial sequence
  Synthetic oligonucleotide
catggcaaaacgaggg

SEQ ID NO: 114 - DNA, 16 bp, Artificial sequence
  Synthetic oligonucleotide
ctggttcatggcaaaa

SEQ ID NO: 115 - DNA, 16 bp, Artificial sequence
  Synthetic oligonucleotide
ttcactggagcactct

SEQ ID NO: 116 - DNA, 16 bp, Artificial sequence
  Synthetic oligonucleotide
attcctgagacatccc

SEQ ID NO: 117 - DNA, 16 bp, Artificial sequence
  Synthetic oligonucleotide
ttctcaattcctgaga

SEQ ID NO: 118 - DNA, 16 bp, Artificial sequence
  Synthetic oligonucleotide
gtcattgttctcaatt

SEQ ID NO: 119 - DNA, 16 bp, Artificial sequence
  Synthetic oligonucleotide
tgataggtgccactgt

SEQ ID NO: 120 - DNA, 16 bp, Artificial sequence
  Synthetic oligonucleotide
cgagagtgataggtgc

SEQ ID NO: 121 - DNA, 16 bp, Artificial sequence
  Synthetic oligonucleotide
tcatctcgagagtgat

SEQ ID NO: 122 - DNA, 16 bp, Artificial sequence
  Synthetic oligonucleotide
ccacatttgtcccagg

SEQ ID NO: 123 - DNA, 16 bp, Artificial sequence
  Synthetic oligonucleotide
catctccttccagtgt

SEQ ID NO: 124 - DNA, 16 bp, Artificial sequence
  Synthetic oligonucleotide
tctagcttggtggcag

SEQ ID NO: 125 - DNA, 16 bp, Artificial sequence
  Synthetic oligonucleotide
tctttatctagcttgg

SEQ ID NO: 126 - DNA, 16 bp, Artificial sequence
  Synthetic oligonucleotide
aaagctttctttatct

SEQ ID NO: 127 - DNA, 16 bp, Artificial sequence
  Synthetic oligonucleotide
aaaccattattactcc

SEQ ID NO: 128 - DNA, 16 bp, Artificial sequence
  Synthetic oligonucleotide
ctttggaaaccattat

SEQ ID NO: 129 - DNA, 16 bp, Artificial sequence
  Synthetic oligonucleotide
aatactctttggaaac

SEQ ID NO: 130 - DNA, 16 bp, Artificial sequence
  Synthetic oligonucleotide
ctattacttcatagct

SEQ ID NO: 131 - DNA, 16 bp, Artificial sequence
  Synthetic oligonucleotide
aaccaactattacttc

SEQ ID NO: 132 - DNA, 16 bp, Artificial sequence
  Synthetic oligonucleotide
gaggtgctagctggtg

SEQ ID NO: 133 - DNA, 16 bp, Artificial sequence
  Synthetic oligonucleotide
aacccttgaaaataag

SEQ ID NO: 134 - DNA, 16 bp, Artificial sequence
  Synthetic oligonucleotide
aagccttagagtcaat

SEQ ID NO: 135 - DNA, 16 bp, Artificial sequence
  Synthetic oligonucleotide
ccccagacttaattca

SEQ ID NO: 136 - DNA, 16 bp, Artificial sequence
  Synthetic oligonucleotide
aaattggtttattgta

SEQ ID NO: 137 - DNA, 16 bp, Artificial sequence
  Synthetic oligonucleotide
tgctgtgctgggattg

SEQ ID NO: 138 - DNA, 16 bp, Artificial sequence
  Synthetic oligonucleotide
aggcgcgcgcattgtg

SEQ ID NO: 139 - DNA, 16 bp, Artificial sequence
  Synthetic oligonucleotide
tatgagtcaacctgca

SEQ ID NO: 140 - DNA, 16 bp, Artificial sequence
  Synthetic oligonucleotide
tttgggcaaagttcct

SEQ ID NO: 141 - DNA, 16 bp, Artificial sequence
  Synthetic oligonucleotide
tcttctttccactcaa

SEQ ID NO: 142 - DNA, 16 bp, Artificial sequence
  Synthetic oligonucleotide
actttaagaagtatct

SEQ ID NO: 143 - DNA, 16 bp, Artificial sequence
  Synthetic oligonucleotide
tcacttactttaagaa

SEQ ID NO: 144 - DNA, 16 bp, Artificial sequence
  Synthetic oligonucleotide
aacctggtttgtttcc

SEQ ID NO: 145 - DNA, 16 bp, Artificial sequence
  Synthetic oligonucleotide
cctaacaacctggttt

SEQ ID NO: 146 - DNA, 16 bp, Artificial sequence
  Synthetic oligonucleotide
ggctattaagctgttt

SEQ ID NO: 147 - DNA, 16 bp, Artificial sequence
  Synthetic oligonucleotide
agatctcactgaccta

SEQ ID NO: 148 - DNA, 16 bp, Artificial sequence
  Synthetic oligonucleotide
tacttgaagaactatt

SEQ ID NO: 149 - DNA, 16 bp, Artificial sequence
  Synthetic oligonucleotide
accaactacttgaaga

SEQ ID NO: 150 - DNA, 16 bp, Artificial sequence
  Synthetic oligonucleotide
agttgttgaccaacta

SEQ ID NO: 151 - DNA, 16 bp, Artificial sequence
  Synthetic oligonucleotide
ataggaagttgttgac

SEQ ID NO: 152 - DNA, 16 bp, Artificial sequence
  Synthetic oligonucleotide
tattcagcagcttata

SEQ ID NO: 153 - DNA, 16 bp, Artificial sequence
  Synthetic oligonucleotide
ggaagttattcagcag

SEQ ID NO: 154 - DNA, 16 bp, Artificial sequence
  Synthetic oligonucleotide
ccctttacaaaaatag

SEQ ID NO: 155 - DNA, 16 bp, Artificial sequence
  Synthetic oligonucleotide
agcacacaactcagac

SEQ ID NO: 156 - DNA, 16 bp, Artificial sequence
  Synthetic oligonucleotide
taggataaatgaatta

SEQ ID NO: 157 - DNA, 16 bp, Artificial sequence
  Synthetic oligonucleotide
caaaggtaggataaat

SEQ ID NO: 158 - DNA, 16 bp, Artificial sequence
  Synthetic oligonucleotide
tcagagaagaaaggta

SEQ ID NO: 159 - DNA, 16 bp, Artificial sequence
  Synthetic oligonucleotide
cctttaccaaaacgag

SEQ ID NO: 160 - DNA, 16 bp, Artificial sequence
  Synthetic oligonucleotide
tggcattcacagagtt

SEQ ID NO: 161 - DNA, 16 bp, Artificial sequence
  Synthetic oligonucleotide
aagcctgtctggaata

SEQ ID NO: 162 - DNA, 16 bp, Artificial sequence
  Synthetic oligonucleotide
ggtctggaacagatta

SEQ ID NO: 163 - DNA, 16 bp, Artificial sequence
  Synthetic oligonucleotide
tgaaaaggtctggaac

SEQ ID NO: 164 - DNA, 16 bp, Artificial sequence
  Synthetic oligonucleotide
ttggcagagataaaac

SEQ ID NO: 165 - DNA, 16 bp, Artificial sequence
  Synthetic oligonucleotide
atttctttggcagaga

SEQ ID NO: 166 - DNA, 16 bp, Artificial sequence
  Synthetic oligonucleotide
gttcatggctgaaatg

SEQ ID NO: 167 - DNA, 16 bp, Artificial sequence
  Synthetic oligonucleotide
ttcccaagctacccaa

SEQ ID NO: 168 - DNA, 16 bp, Artificial sequence
  Synthetic oligonucleotide
acagaattcccaagct

SEQ ID NO: 169 - DNA, 16 bp, Artificial sequence
  Synthetic oligonucleotide
catagcacagaattcc

SEQ ID NO: 170 - DNA, 16 bp, Artificial sequence
  Synthetic oligonucleotide
aattgtatccagacat

SEQ ID NO: 171 - DNA, 16 bp, Artificial sequence
  Synthetic oligonucleotide
ctttaagccacatggt

SEQ ID NO: 172 - DNA, 16 bp, Artificial sequence
  Synthetic oligonucleotide
aaattactttaagcca

SEQ ID NO: 173 - DNA, 16 bp, Artificial sequence
  Synthetic oligonucleotide
aagacggataaaaatt

SEQ ID NO: 174 - DNA, 16 bp, Artificial sequence
  Synthetic oligonucleotide
aaaaataagacggata

SEQ ID NO: 175 - DNA, 16 bp, Artificial sequence
  Synthetic oligonucleotide
cctaagagtaaaaaat

SEQ ID NO: 176 - DNA, 16 bp, Artificial sequence
  Synthetic oligonucleotide
acctgacattttggag

SEQ ID NO: 177 - DNA, 16 bp, Artificial sequence
  Synthetic oligonucleotide
gagcctacctgacatt

SEQ ID NO: 178 - DNA, 16 bp, Artificial sequence
  Synthetic oligonucleotide
atccaattatgtccca

SEQ ID NO: 179 - DNA, 16 bp, Artificial sequence
  Synthetic oligonucleotide
aggagtcgggcagctt

SEQ ID NO: 180 - DNA, 16 bp, Artificial sequence
  Synthetic oligonucleotide
tgaagaaggagtcggg

SEQ ID NO: 181 - DNA, 16 bp, Artificial sequence
  Synthetic oligonucleotide
gcggcttgaagaagga

SEQ ID NO: 182 - DNA, 16 bp, Artificial sequence
  Synthetic oligonucleotide
gcatcagtactggcct

SEQ ID NO: 183 - DNA, 16 bp, Artificial sequence
  Synthetic oligonucleotide
aacatgctgtggagtc

SEQ ID NO: 184 - DNA, 16 bp, Artificial sequence
  Synthetic oligonucleotide
gagctcgaacatgctg

SEQ ID NO: 185 - DNA, 16 bp, Artificial sequence
  Synthetic oligonucleotide
gatttaagaagtatct

SEQ ID NO: 186 - DNA, 16 bp, Artificial sequence
  Synthetic oligonucleotide
ccatgttgttgtctga

SEQ ID NO: 187 - DNA, 16 bp, Artificial sequence
  Synthetic oligonucleotide
atccatcaggaagagg

SEQ ID NO: 188 - DNA, 16 bp, Artificial sequence
  Synthetic oligonucleotide
cctgagtcatggcttg

SEQ ID NO: 189 - DNA, 16 bp, Artificial sequence
  Synthetic oligonucleotide
ctccatcctgagtcat

SEQ ID NO: 190 - DNA, 16 bp, Artificial sequence
  Synthetic oligonucleotide
ggtcttgttcttatgg

SEQ ID NO: 191 - DNA, 16 bp, Artificial sequence
  Synthetic oligonucleotide
ttcatggcaaaacgag

SEQ ID NO: 192 - DNA, 16 bp, Artificial sequence
  Synthetic oligonucleotide
ctctggttcatggcaa

SEQ ID NO: 193 - DNA, 16 bp, Artificial sequence
  Synthetic oligonucleotide
tccctgtgggctctgg

SEQ ID NO: 194 - DNA, 16 bp, Artificial sequence
  Synthetic oligonucleotide
caattcctgagacatc

SEQ ID NO: 195 - DNA, 16 bp, Artificial sequence
  Synthetic oligonucleotide
ttgttctcaattcctg

SEQ ID NO: 196 - DNA, 16 bp, Artificial sequence
  Synthetic oligonucleotide
aggtgccactgttaag

SEQ ID NO: 197 - DNA, 16 bp, Artificial sequence
  Synthetic oligonucleotide
agtgataggtgccact

SEQ ID NO: 198 - DNA, 16 bp, Artificial sequence
  Synthetic oligonucleotide
ctcgagagtgataggt

SEQ ID NO: 199 - DNA, 16 bp, Artificial sequence
  Synthetic oligonucleotide
tctcatctcgagagtg

SEQ ID NO: 200 - DNA, 16 bp, Artificial sequence
  Synthetic oligonucleotide
gtccacatttgtccca

SEQ ID NO: 201 - DNA, 16 bp, Artificial sequence
  Synthetic oligonucleotide
gcttggtggcagccaa

SEQ ID NO: 202 - DNA, 16 bp, Artificial sequence
  Synthetic oligonucleotide
tatctagcttggtggc

SEQ ID NO: 203 - DNA, 16 bp, Artificial sequence
  Synthetic oligonucleotide
ctttctttatctagct

SEQ ID NO: 204 - DNA, 16 bp, Artificial sequence
  Synthetic oligonucleotide
agacacatactctagt

SEQ ID NO: 205 - DNA, 16 bp, Artificial sequence
  Synthetic oligonucleotide
ggaaaccattattact

SEQ ID NO: 206 - DNA, 16 bp, Artificial sequence
  Synthetic oligonucleotide
ctctttggaaaccatt

SEQ ID NO: 207 - DNA, 16 bp, Artificial sequence
  Synthetic oligonucleotide
tacttcatagcttata

SEQ ID NO: 208 - DNA, 16 bp, Artificial sequence
  Synthetic oligonucleotide
aactattacttcatag

SEQ ID NO: 209 - DNA, 16 bp, Artificial sequence
  Synthetic oligonucleotide
gctagctggtgccact

SEQ ID NO: 210 - DNA, 16 bp, Artificial sequence
  Synthetic oligonucleotide
acagaggtgctagctg

SEQ ID NO: 211 - DNA, 16 bp, Artificial sequence
  Synthetic oligonucleotide
tgaacccttgaaaata

SEQ ID NO: 212 - DNA, 16 bp, Artificial sequence
  Synthetic oligonucleotide
aaaagccttagagtca

SEQ ID NO: 213 - DNA, 16 bp, Artificial sequence
  Synthetic oligonucleotide
tggtttattgtaaaag

SEQ ID NO: 214 - DNA, 16 bp, Artificial sequence
  Synthetic oligonucleotide
tgggattgatattccg

SEQ ID NO: 215 - DNA, 16 bp, Artificial sequence
  Synthetic oligonucleotide
atttgctgtgctggga

SEQ ID NO: 216 - DNA, 16 bp, Artificial sequence
  Synthetic oligonucleotide
gcggaggcgcgcgcat

SEQ ID NO: 217 - DNA, 16 bp, Artificial sequence
  Synthetic oligonucleotide
cctatgagtcaacctg

SEQ ID NO: 218 - DNA, 16 bp, Artificial sequence
  Synthetic oligonucleotide
ttccactcaagttaca

SEQ ID NO: 219 - DNA, 16 bp, Artificial sequence
  Synthetic oligonucleotide
actcttctttccactc

SEQ ID NO: 220 - DNA, 16 bp, Artificial sequence
  Synthetic oligonucleotide
ttactttaagaagtat

SEQ ID NO: 221 - DNA, 16 bp, Artificial sequence
  Synthetic oligonucleotide
aaacctgatcctttga

SEQ ID NO: 222 - DNA, 16 bp, Artificial sequence
  Synthetic oligonucleotide
acaacctggtttgttt

SEQ ID NO: 223 - DNA, 16 bp, Artificial sequence
  Synthetic oligonucleotide
tccccaggtcagcatg

SEQ ID NO: 224 - DNA, 16 bp, Artificial sequence
  Synthetic oligonucleotide
acttggcaccaaaagc

SEQ ID NO: 225 - DNA, 16 bp, Artificial sequence
  Synthetic oligonucleotide
tgaagaactatttcct

SEQ ID NO: 226 - DNA, 16 bp, Artificial sequence
  Synthetic oligonucleotide
actacttgaagaacta

SEQ ID NO: 227 - DNA, 16 bp, Artificial sequence
  Synthetic oligonucleotide
tgaccaactacttgaa

SEQ ID NO: 228 - DNA, 16 bp, Artificial sequence
  Synthetic oligonucleotide
gaagttgttgaccaac

SEQ ID NO: 229 - DNA, 16 bp, Artificial sequence
  Synthetic oligonucleotide
aaataggaagttgttg

SEQ ID NO: 230 - DNA, 16 bp, Artificial sequence
  Synthetic oligonucleotide
gttattcagcagctta

SEQ ID NO: 231 - DNA, 16 bp, Artificial sequence
  Synthetic oligonucleotide
caggaagttattcagc

SEQ ID NO: 232 - DNA, 16 bp, Artificial sequence
  Synthetic oligonucleotide
cacaactcagacaggg

SEQ ID NO: 233 - DNA, 16 bp, Artificial sequence
  Synthetic oligonucleotide
caagcacacaactcag

SEQ ID NO: 234 - DNA, 16 bp, Artificial sequence
  Synthetic oligonucleotide
ggtaggataaatgaat

SEQ ID NO: 235 - DNA, 16 bp, Artificial sequence
  Synthetic oligonucleotide
gccaaaggtaggataa

SEQ ID NO: 236 - DNA, 16 bp, Artificial sequence
  Synthetic oligonucleotide
tatatatggtagtcta

SEQ ID NO: 237 - DNA, 16 bp, Artificial sequence
  Synthetic oligonucleotide
aacctttaccaaaacg

SEQ ID NO: 238 - DNA, 16 bp, Artificial sequence
  Synthetic oligonucleotide
ctgtctggaatacaca

SEQ ID NO: 239 - DNA, 16 bp, Artificial sequence
  Synthetic oligonucleotide
gtcaagcctgtctgga

SEQ ID NO: 240 - DNA, 16 bp, Artificial sequence
  Synthetic oligonucleotide
aaggtctggaacagat

SEQ ID NO: 241 - DNA, 16 bp, Artificial sequence
  Synthetic oligonucleotide
agcagctaacagcttg

SEQ ID NO: 242 - DNA, 16 bp, Artificial sequence
  Synthetic oligonucleotide
ctttggcagagataaa

SEQ ID NO: 243 - DNA, 16 bp, Artificial sequence
  Synthetic oligonucleotide
atatttctttggcaga

SEQ ID NO: 244 - DNA, 16 bp, Artificial sequence
  Synthetic oligonucleotide
ctggttcatggctgaa

SEQ ID NO: 245 - DNA, 16 bp, Artificial sequence
  Synthetic oligonucleotide
aattcccaagctaccc

SEQ ID NO: 246 - DNA, 16 bp, Artificial sequence
  Synthetic oligonucleotide
gcacagaattcccaag

SEQ ID NO: 247 - DNA, 16 bp, Artificial sequence
  Synthetic oligonucleotide
accatagcacagaatt

SEQ ID NO: 248 - DNA, 16 bp, Artificial sequence
  Synthetic oligonucleotide
tgtgtaggctgactta

SEQ ID NO: 249 - DNA, 16 bp, Artificial sequence
  Synthetic oligonucleotide
tactttaagccacatg

SEQ ID NO: 250 - DNA, 16 bp, Artificial sequence
  Synthetic oligonucleotide
cggataaaaattactt

SEQ ID NO: 251 - DNA, 16 bp, Artificial sequence
  Synthetic oligonucleotide
ataagacggataaaaa

SEQ ID NO: 252 - DNA, 16 bp, Artificial sequence
  Synthetic oligonucleotide
taaaaaataagacgga

SEQ ID NO: 253 - DNA, 16 bp, Artificial sequence
  Synthetic oligonucleotide
tgcctaagagtaaaaa

SEQ ID NO: 254 - DNA, 16 bp, Artificial sequence
  Synthetic oligonucleotide
ctacctgacattttgg

SEQ ID NO: 255 - DNA, 16 bp, Artificial sequence
  Synthetic oligonucleotide
aagagcctacctgaca

SEQ ID NO: 256 - DNA, 16 bp, Artificial sequence
  Synthetic oligonucleotide
gtgataggtgccacta

SEQ ID NO: 257 - DNA, 16 bp, Artificial sequence
  Synthetic oligonucleotide
tttccctggcggcggc

SEQ ID NO: 258 - DNA, 16 bp, Artificial sequence
  Synthetic oligonucleotide
actttttccctccaac

SEQ ID NO: 259 - DNA, 16 bp, Artificial sequence
  Synthetic oligonucleotide
ctgcgccccggctcca

SEQ ID NO: 260 - DNA, 16 bp, Artificial sequence
  Synthetic oligonucleotide
gacggctgcgggccgg

SEQ ID NO: 261 - DNA, 16 bp, Artificial sequence
  Synthetic oligonucleotide
cgagggctacgcccgg

SEQ ID NO: 262 - DNA, 16 bp, Artificial sequence
  Synthetic oligonucleotide
ggttgaggcggcggct

SEQ ID NO: 263 - DNA, 16 bp, Artificial sequence
  Synthetic oligonucleotide
cgccgcgggtgccggt

SEQ ID NO: 264 - DNA, 16 bp, Artificial sequence
  Synthetic oligonucleotide
catgggcacggtctgg

SEQ ID NO: 265 - DNA, 16 bp, Artificial sequence
  Synthetic oligonucleotide
cagtgcctgcatcagt

SEQ ID NO: 266 - DNA, 16 bp, Artificial sequence
  Synthetic oligonucleotide
caactgcagagaagct

SEQ ID NO: 267 - DNA, 16 bp, Artificial sequence
  Synthetic oligonucleotide
cgaagatgctgagctg

SEQ ID NO: 268 - DNA, 16 bp, Artificial sequence
  Synthetic oligonucleotide
ccagaagatgtctttg

SEQ ID NO: 269 - DNA, 16 bp, Artificial sequence
  Synthetic oligonucleotide
agcatggccttcctgg

SEQ ID NO: 270 - DNA, 16 bp, Artificial sequence
  Synthetic oligonucleotide
ttcccatccatcagga

SEQ ID NO: 271 - DNA, 16 bp, Artificial sequence
  Synthetic oligonucleotide
agaggtggtcttgttc

SEQ ID NO: 272 - DNA, 16 bp, Artificial sequence
  Synthetic oligonucleotide
ggagcactctgactga

SEQ ID NO: 273 - DNA, 16 bp, Artificial sequence
  Synthetic oligonucleotide
gttgctgcagtcgcat

SEQ ID NO: 274 - DNA, 16 bp, Artificial sequence
  Synthetic oligonucleotide
ggcctcacctgccgaa

SEQ ID NO: 275 - DNA, 16 bp, Artificial sequence
  Synthetic oligonucleotide
taactcctgacatttt

SEQ ID NO: 276 - DNA, 16 bp, Artificial sequence
  Synthetic oligonucleotide
ccgggagaagacactg

SEQ ID NO: 277 - DNA, 16 bp, Artificial sequence
  Synthetic oligonucleotide
actctcatctcgagag

SEQ ID NO: 278 - DNA, 16 bp, Artificial sequence
  Synthetic oligonucleotide
caggaagtcatctggg

SEQ ID NO: 279 - DNA, 16 bp, Artificial sequence
  Synthetic oligonucleotide
gtagtctgggaaacgg

SEQ ID NO: 280 - DNA, 16 bp, Artificial sequence
  Synthetic oligonucleotide
agctcctctccttcta

SEQ ID NO: 281 - DNA, 16 bp, Artificial sequence
  Synthetic oligonucleotide
cctgagggctctataa

SEQ ID NO: 282 - DNA, 16 bp, Artificial sequence
  Synthetic oligonucleotide
tattagcctgaaaact

SEQ ID NO: 283 - DNA, 16 bp, Artificial sequence
  Synthetic oligonucleotide
gcaatggacaaggaag

SEQ ID NO: 284 - DNA, 16 bp, Artificial sequence
  Synthetic oligonucleotide
agcccccaaaatgaac

SEQ ID NO: 285 - DNA, 16 bp, Artificial sequence
  Synthetic oligonucleotide
taactgggcaaaagga

SEQ ID NO: 286 - DNA, 16 bp, Artificial sequence
  Synthetic oligonucleotide
agcatctgacttctaa

SEQ ID NO: 287 - DNA, 16 bp, Artificial sequence
  Synthetic oligonucleotide
actggacaaaggaagc

SEQ ID NO: 288 - DNA, 16 bp, Artificial sequence
  Synthetic oligonucleotide
gtatttaatatcagat

SEQ ID NO: 289 - DNA, 16 bp, Artificial sequence
  Synthetic oligonucleotide
gcactaggaggaaaag

SEQ ID NO: 290 - DNA, 16 bp, Artificial sequence
  Synthetic oligonucleotide
gtatgtggcaataatt

SEQ ID NO: 291 - DNA, 16 bp, Artificial sequence
  Synthetic oligonucleotide
ccgacaaaaccaacca

SEQ ID NO: 292 - DNA, 16 bp, Artificial sequence
  Synthetic oligonucleotide
cccaagctacaactat

SEQ ID NO: 293 - DNA, 16 bp, Artificial sequence
  Synthetic oligonucleotide
cgagatttaaataagg

SEQ ID NO: 294 - DNA, 16 bp, Artificial sequence
  Synthetic oligonucleotide
aaaggatacattccac

SEQ ID NO: 295 - DNA, 16 bp, Artificial sequence
  Synthetic oligonucleotide
tattctaaatgcatac

SEQ ID NO: 296 - DNA, 16 bp, Artificial sequence
  Synthetic oligonucleotide
gactgccccaaccaga

SEQ ID NO: 297 - DNA, 16 bp, Artificial sequence
  Synthetic oligonucleotide
gtggagcactccccta

SEQ ID NO: 298 - DNA, 16 bp, Artificial sequence
  Synthetic oligonucleotide
gtttgctcctttccaa

SEQ ID NO: 299 - DNA, 16 bp, Artificial sequence
  Synthetic oligonucleotide
gtcatgcacattatga

SEQ ID NO: 300 - DNA, 16 bp, Artificial sequence
  Synthetic oligonucleotide
cttccaaaactaaggc

SEQ ID NO: 301 - DNA, 16 bp, Artificial sequence
  Synthetic oligonucleotide
tattttaatctagtcg

SEQ ID NO: 302 - DNA, 16 bp, Artificial sequence
  Synthetic oligonucleotide
tcagcatagaagtagg

SEQ ID NO: 303 - DNA, 16 bp, Artificial sequence
  Synthetic oligonucleotide
cacttttccagctaac

SEQ ID NO: 304 - DNA, 16 bp, Artificial sequence
  Synthetic oligonucleotide
acacatactctagtta

SEQ ID NO: 305 - DNA, 16 bp, Artificial sequence
  Synthetic oligonucleotide
acaaccaactattact

SEQ ID NO: 306 - DNA, 16 bp, Artificial sequence
  Synthetic oligonucleotide
acattgaaagaccctt

SEQ ID NO: 307 - DNA, 16 bp, Artificial sequence
  Synthetic oligonucleotide
gaagagattttatgcc

SEQ ID NO: 308 - DNA, 16 bp, Artificial sequence
  Synthetic oligonucleotide
ttttgccctcctccaa

SEQ ID NO: 309 - DNA, 16 bp, Artificial sequence
  Synthetic oligonucleotide
cacagtgattgcattt

SEQ ID NO: 310 - DNA, 16 bp, Artificial sequence
  Synthetic oligonucleotide
gatttaatctttctgc

SEQ ID NO: 311 - DNA, 16 bp, Artificial sequence
  Synthetic oligonucleotide
ctaggtagaatttcat

SEQ ID NO: 312 - DNA, 16 bp, Artificial sequence
  Synthetic oligonucleotide
gatcttctgcacatta

SEQ ID NO: 313 - DNA, 16 bp, Artificial sequence
  Synthetic oligonucleotide
gctgatatataagata

SEQ ID NO: 314 - DNA, 16 bp, Artificial sequence
  Synthetic oligonucleotide
ttcacaaccccccccc

SEQ ID NO: 315 - DNA, 16 bp, Artificial sequence
  Synthetic oligonucleotide
agtctttattaaagag

SEQ ID NO: 316 - DNA, 16 bp, Artificial sequence
  Synthetic oligonucleotide
caaattaaagttgagg

SEQ ID NO: 317 - DNA, 16 bp, Artificial sequence
  Synthetic oligonucleotide
tcaaagcactgtgcca

SEQ ID NO: 318 - DNA, 16 bp, Artificial sequence
  Synthetic oligonucleotide
caaactcaaaaaggga

SEQ ID NO: 319 - DNA, 16 bp, Artificial sequence
  Synthetic oligonucleotide
caagaagcagttaagc

SEQ ID NO: 320 - DNA, 16 bp, Artificial sequence
  Synthetic oligonucleotide
cctgactgaaaataac

SEQ ID NO: 321 - DNA, 16 bp, Artificial sequence
  Synthetic oligonucleotide
tctgaaactccaaatc

SEQ ID NO: 322 - DNA, 16 bp, Artificial sequence
  Synthetic oligonucleotide
taaaggcactacattt

SEQ ID NO: 323 - DNA, 16 bp, Artificial sequence
  Synthetic oligonucleotide
tacttaacacagcaac

SEQ ID NO: 324 - DNA, 16 bp, Artificial sequence
  Synthetic oligonucleotide
ggtatgaattctgaat

SEQ ID NO: 325 - DNA, 16 bp, Artificial sequence
  Synthetic oligonucleotide
gcactgaatattgcca

SEQ ID NO: 326 - DNA, 16 bp, Artificial sequence
  Synthetic oligonucleotide
atccacctgagcactc

SEQ ID NO: 327 - DNA, 16 bp, Artificial sequence
  Synthetic oligonucleotide
gcattaaagaattctc

SEQ ID NO: 328 - DNA, 16 bp, Artificial sequence
  Synthetic oligonucleotide
cctaacatatgagcat

SEQ ID NO: 329 - DNA, 16 bp, Artificial sequence
  Synthetic oligonucleotide
gggctaactacattgc

SEQ ID NO: 330 - DNA, 16 bp, Artificial sequence
  Synthetic oligonucleotide
gattttttctgagttc

SEQ ID NO: 331 - DNA, 16 bp, Artificial sequence
  Synthetic oligonucleotide
tacactgtatatgttc

SEQ ID NO: 332 - DNA, 16 bp, Artificial sequence
  Synthetic oligonucleotide
tctgtcagttatccta

SEQ ID NO: 333 - DNA, 16 bp, Artificial sequence
  Synthetic oligonucleotide
tgcctttccccgcctc

SEQ ID NO: 334 - DNA, 16 bp, Artificial sequence
  Synthetic oligonucleotide
ctcggacctgcggcgc

SEQ ID NO: 335 - DNA, 16 bp, Artificial sequence
  Synthetic oligonucleotide
gcatcccccgccccgg

SEQ ID NO: 336 - DNA, 16 bp, Artificial sequence
  Synthetic oligonucleotide
cgaggtggagaagcgg

SEQ ID NO: 337 - DNA, 16 bp, Artificial sequence
  Synthetic oligonucleotide
cccctgacccaggcga

SEQ ID NO: 338 - DNA, 16 bp, Artificial sequence
  Synthetic oligonucleotide
aggcggctgcccttgg

SEQ ID NO: 339 - DNA, 16 bp, Artificial sequence
  Synthetic oligonucleotide
tctgatgcccggcggg

SEQ ID NO: 340 - DNA, 16 bp, Artificial sequence
  Synthetic oligonucleotide
gtcgggcagcttccgg

SEQ ID NO: 341 - DNA, 16 bp, Artificial sequence
  Synthetic oligonucleotide
tggagtcagggctcct

SEQ ID NO: 342 - DNA, 16 bp, Artificial sequence
  Synthetic oligonucleotide
ggtcagtgtcccagga

SEQ ID NO: 343 - DNA, 16 bp, Artificial sequence
  Synthetic oligonucleotide
ggtatctcaaaagaag

SEQ ID NO: 344 - DNA, 16 bp, Artificial sequence
  Synthetic oligonucleotide
ttaagaagtatctctg

SEQ ID NO: 345 - DNA, 16 bp, Artificial sequence
  Synthetic oligonucleotide
tcatcatattctgctg

SEQ ID NO: 346 - DNA, 16 bp, Artificial sequence
  Synthetic oligonucleotide
atttctccatcctgag

SEQ ID NO: 347 - DNA, 16 bp, Artificial sequence
  Synthetic oligonucleotide
agccttgggtctagcc

SEQ ID NO: 348 - DNA, 16 bp, Artificial sequence
  Synthetic oligonucleotide
ctgccacccatgacgc

SEQ ID NO: 349 - DNA, 16 bp, Artificial sequence
  Synthetic oligonucleotide
gccgcagcctctcctt

SEQ ID NO: 350 - DNA, 16 bp, Artificial sequence
  Synthetic oligonucleotide
tattccgcattgcctg

SEQ ID NO: 351 - DNA, 16 bp, Artificial sequence
  Synthetic oligonucleotide
aactggctacgcaggg

SEQ ID NO: 352 - DNA, 16 bp, Artificial sequence
  Synthetic oligonucleotide
cgtcattgttctcaat

SEQ ID NO: 353 - DNA, 16 bp, Artificial sequence
  Synthetic oligonucleotide
cttagtccactgtctg

SEQ ID NO: 354 - DNA, 16 bp, Artificial sequence
  Synthetic oligonucleotide
gtatcacctgtatcca

SEQ ID NO: 355 - DNA, 16 bp, Artificial sequence
  Synthetic oligonucleotide
tccaaggtccacattt

SEQ ID NO: 356 - DNA, 16 bp, Artificial sequence
  Synthetic oligonucleotide
aaggatgtcagaactc

SEQ ID NO: 357 - DNA, 16 bp, Artificial sequence
  Synthetic oligonucleotide
tttccggtgcatgtgt

SEQ ID NO: 358 - DNA, 16 bp, Artificial sequence
  Synthetic oligonucleotide
agtatcttgctggacg

SEQ ID NO: 359 - DNA, 16 bp, Artificial sequence
  Synthetic oligonucleotide
gcaatacattaacagc

SEQ ID NO: 360 - DNA, 16 bp, Artificial sequence
  Synthetic oligonucleotide
acaggctcacttcccc

SEQ ID NO: 361 - DNA, 16 bp, Artificial sequence
  Synthetic oligonucleotide
aatgattggtgaacat

SEQ ID NO: 362 - DNA, 16 bp, Artificial sequence
  Synthetic oligonucleotide
taaatgctgtgacatg

SEQ ID NO: 363 - DNA, 16 bp, Artificial sequence
  Synthetic oligonucleotide
ccagtaaatcatgttt

SEQ ID NO: 364 - DNA, 16 bp, Artificial sequence
  Synthetic oligonucleotide
ctcttcaaatcagcat

SEQ ID NO: 365 - DNA, 16 bp, Artificial sequence
  Synthetic oligonucleotide
ttatgtgactaatgat

SEQ ID NO: 366 - DNA, 16 bp, Artificial sequence
  Synthetic oligonucleotide
gcacacccacaaaatt

SEQ ID NO: 367 - DNA, 16 bp, Artificial sequence
  Synthetic oligonucleotide
ggtcatttgcctaggt

SEQ ID NO: 368 - DNA, 16 bp, Artificial sequence
  Synthetic oligonucleotide
ttaccaaaacaactac

SEQ ID NO: 369 - DNA, 16 bp, Artificial sequence
  Synthetic oligonucleotide
gttatgtttgggtgtg

SEQ ID NO: 370 - DNA, 16 bp, Artificial sequence
  Synthetic oligonucleotide
aagcagggaaacctaa

SEQ ID NO: 371 - DNA, 16 bp, Artificial sequence
  Synthetic oligonucleotide
ataaactactagtcat

SEQ ID NO: 372 - DNA, 16 bp, Artificial sequence
  Synthetic oligonucleotide
tacttcaaacatctgc

SEQ ID NO: 373 - DNA, 16 bp, Artificial sequence
  Synthetic oligonucleotide
ccgtatgcccagaggg

SEQ ID NO: 374 - DNA, 16 bp, Artificial sequence
  Synthetic oligonucleotide
aatcgagacttaaaaa

SEQ ID NO: 375 - DNA, 16 bp, Artificial sequence
  Synthetic oligonucleotide
ctataaagcttatttc

SEQ ID NO: 376 - DNA, 16 bp, Artificial sequence
  Synthetic oligonucleotide
gaactacaaactagaa

SEQ ID NO: 377 - DNA, 16 bp, Artificial sequence
  Synthetic oligonucleotide
gaacaatcttgaaggc

SEQ ID NO: 378 - DNA, 16 bp, Artificial sequence
  Synthetic oligonucleotide
ctatccagggtcaatt

SEQ ID NO: 379 - DNA, 16 bp, Artificial sequence
  Synthetic oligonucleotide
actaccaatatacatt

SEQ ID NO: 380 - DNA, 16 bp, Artificial sequence
  Synthetic oligonucleotide
cattattactcctgta

SEQ ID NO: 381 - DNA, 16 bp, Artificial sequence
  Synthetic oligonucleotide
ctggtgccactttaat

SEQ ID NO: 382 - DNA, 16 bp, Artificial sequence
  Synthetic oligonucleotide
aagggcttattctaga

SEQ ID NO: 383 - DNA, 16 bp, Artificial sequence
  Synthetic oligonucleotide
agcagcttttgccagg

SEQ ID NO: 384 - DNA, 16 bp, Artificial sequence
  Synthetic oligonucleotide
aacttcttacttccaa

SEQ ID NO: 385 - DNA, 16 bp, Artificial sequence
  Synthetic oligonucleotide
ttattatgagtgatca

SEQ ID NO: 386 - DNA, 16 bp, Artificial sequence
  Synthetic oligonucleotide
tctgcagtggccattt

SEQ ID NO: 387 - DNA, 16 bp, Artificial sequence
  Synthetic oligonucleotide
tatacccaattttgca

SEQ ID NO: 388 - DNA, 16 bp, Artificial sequence
  Synthetic oligonucleotide
actccttccaagtagc

SEQ ID NO: 389 - DNA, 16 bp, Artificial sequence
  Synthetic oligonucleotide
taagctaaagctaatc

SEQ ID NO: 390 - DNA, 16 bp, Artificial sequence
  Synthetic oligonucleotide
caaggtccccctaaat

SEQ ID NO: 391 - DNA, 16 bp, Artificial sequence
  Synthetic oligonucleotide
cagcacggtgtaagac

SEQ ID NO: 392 - DNA, 16 bp, Artificial sequence
  Synthetic oligonucleotide
actgaggtataactgg

SEQ ID NO: 393 - DNA, 16 bp, Artificial sequence
  Synthetic oligonucleotide
agtacagagggcatcg

SEQ ID NO: 394 - DNA, 16 bp, Artificial sequence
  Synthetic oligonucleotide
acatcaaggctatgat

SEQ ID NO: 395 - DNA, 16 bp, Artificial sequence
  Synthetic oligonucleotide
caattcaagaataccc

SEQ ID NO: 396 - DNA, 16 bp, Artificial sequence
  Synthetic oligonucleotide
aagtagatctaagaag

SEQ ID NO: 397 - DNA, 16 bp, Artificial sequence
  Synthetic oligonucleotide
aatagtgctttggaag

SEQ ID NO: 398 - DNA, 16 bp, Artificial sequence
  Synthetic oligonucleotide
cttccctgtgttcatt

SEQ ID NO: 399 - DNA, 16 bp, Artificial sequence
  Synthetic oligonucleotide
gcatgtatttaatatg

SEQ ID NO: 400 - DNA, 16 bp, Artificial sequence
  Synthetic oligonucleotide
gagtttcaacactgat

SEQ ID NO: 401 - DNA, 16 bp, Artificial sequence
  Synthetic oligonucleotide
cgctagaaaagtgtta

SEQ ID NO: 402 - DNA, 16 bp, Artificial sequence
  Synthetic oligonucleotide
atgcttgcgaggataa

SEQ ID NO: 403 - DNA, 16 bp, Artificial sequence
  Synthetic oligonucleotide
attggtactatatata

SEQ ID NO: 404 - DNA, 16 bp, Artificial sequence
  Synthetic oligonucleotide
taacaatttatgtaag

SEQ ID NO: 405 - DNA, 16 bp, Artificial sequence
  Synthetic oligonucleotide
tgaagcaagttctcaa

SEQ ID NO: 406 - DNA, 16 bp, Artificial sequence
  Synthetic oligonucleotide
ggtaactcttctttcc

SEQ ID NO: 407 - DNA, 16 bp, Artificial sequence
  Synthetic oligonucleotide
ctccttaacccgggtt

SEQ ID NO: 408 - DNA, 16 bp, Artificial sequence
  Synthetic oligonucleotide
cagtaagaagccaaaa

SEQ ID NO: 409 - DNA, 16 bp, Artificial sequence
  Synthetic oligonucleotide
aaagaacttagttccc

SEQ ID NO: 410 - DNA, 16 bp, Artificial sequence
  Synthetic oligonucleotide
aactttcacataaact

SEQ ID NO: 411 - DNA, 16 bp, Artificial sequence
  Synthetic oligonucleotide
acggaggccggacagc

SEQ ID NO: 412 - DNA, 16 bp, Artificial sequence
  Synthetic oligonucleotide
ggtctggcggctgcgc

SEQ ID NO: 413 - DNA, 16 bp, Artificial sequence
  Synthetic oligonucleotide
tcgctctcagggccgg

SEQ ID NO: 414 - DNA, 16 bp, Artificial sequence
  Synthetic oligonucleotide
cgccccggctccacgg

SEQ ID NO: 415 - DNA, 16 bp, Artificial sequence
  Synthetic oligonucleotide
ctgcccgggatccatg

SEQ ID NO: 416 - DNA, 16 bp, Artificial sequence
  Synthetic oligonucleotide
cggacggcgggccctg

SEQ ID NO: 417 - DNA, 16 bp, Artificial sequence
  Synthetic oligonucleotide
caggtcggtctccgag

SEQ ID NO: 418 - DNA, 16 bp, Artificial sequence
  Synthetic oligonucleotide
cggcggcttgaagaag

SEQ ID NO: 419 - DNA, 16 bp, Artificial sequence
  Synthetic oligonucleotide
atgagctcgaacatgc

SEQ ID NO: 420 - DNA, 16 bp, Artificial sequence
  Synthetic oligonucleotide
gagactactccagtgg

SEQ ID NO: 421 - DNA, 16 bp, Artificial sequence
  Synthetic oligonucleotide
gcagaggtacatcatc

SEQ ID NO: 422 - DNA, 16 bp, Artificial sequence
  Synthetic oligonucleotide
tgtctgatcgatgtga

SEQ ID NO: 423 - DNA, 16 bp, Artificial sequence
  Synthetic oligonucleotide
aggacctgaagccgag

SEQ ID NO: 424 - DNA, 16 bp, Artificial sequence
  Synthetic oligonucleotide
tatggtttatatagta

SEQ ID NO: 425 - DNA, 16 bp, Artificial sequence
  Synthetic oligonucleotide
tctctggttcatggca

SEQ ID NO: 426 - DNA, 16 bp, Artificial sequence
  Synthetic oligonucleotide
ttgctgctggttggag

SEQ ID NO: 427 - DNA, 16 bp, Artificial sequence
  Synthetic oligonucleotide
cagttcttgctgtttc

SEQ ID NO: 428 - DNA, 16 bp, Artificial sequence
  Synthetic oligonucleotide
aatttgctgtgctggg

SEQ ID NO: 429 - DNA, 16 bp, Artificial sequence
  Synthetic oligonucleotide
attttgagtcccacca

SEQ ID NO: 430 - DNA, 16 bp, Artificial sequence
  Synthetic oligonucleotide
tgttaaggaaaggatc

SEQ ID NO: 431 - DNA, 16 bp, Artificial sequence
  Synthetic oligonucleotide
cactgtagctgctcat

SEQ ID NO: 432 - DNA, 16 bp, Artificial sequence
  Synthetic oligonucleotide
tctgctgtgagggcag

SEQ ID NO: 433 - DNA, 16 bp, Artificial sequence
  Synthetic oligonucleotide
gttcattccatctcct

SEQ ID NO: 434 - DNA, 16 bp, Artificial sequence
  Synthetic oligonucleotide
tgtaagaaagctttct

SEQ ID NO: 435 - DNA, 16 bp, Artificial sequence
  Synthetic oligonucleotide
caactggcttatggaa

SEQ ID NO: 436 - DNA, 16 bp, Artificial sequence
  Synthetic oligonucleotide
gcaaaatagaggatta

SEQ ID NO: 437 - DNA, 16 bp, Artificial sequence
  Synthetic oligonucleotide
tttgattctttagagc

SEQ ID NO: 438 - DNA, 16 bp, Artificial sequence
  Synthetic oligonucleotide
tggcatccatcatcca

SEQ ID NO: 439 - DNA, 16 bp, Artificial sequence
  Synthetic oligonucleotide
tctgagtatttagtta

SEQ ID NO: 440 - DNA, 16 bp, Artificial sequence
  Synthetic oligonucleotide
acaactgttgaacaaa

SEQ ID NO: 441 - DNA, 16 bp, Artificial sequence
  Synthetic oligonucleotide
atttttggcttgtcag

SEQ ID NO: 442 - DNA, 16 bp, Artificial sequence
  Synthetic oligonucleotide
gccttggtttcagcta

SEQ ID NO: 443 - DNA, 16 bp, Artificial sequence
  Synthetic oligonucleotide
aaattgtctcatgcct

SEQ ID NO: 444 - DNA, 16 bp, Artificial sequence
  Synthetic oligonucleotide
ccaaccaaccccccca

SEQ ID NO: 445 - DNA, 16 bp, Artificial sequence
  Synthetic oligonucleotide
aacagattcactaata

SEQ ID NO: 446 - DNA, 16 bp, Artificial sequence
  Synthetic oligonucleotide
ggtaaaaaaaaccagg

SEQ ID NO: 447 - DNA, 16 bp, Artificial sequence
  Synthetic oligonucleotide
accacactattataaa

SEQ ID NO: 448 - DNA, 16 bp, Artificial sequence
  Synthetic oligonucleotide
cgctaccattttaaaa

SEQ ID NO: 449 - DNA, 16 bp, Artificial sequence
  Synthetic oligonucleotide
ttaaactaccagtgaa

SEQ ID NO: 450 - DNA, 16 bp, Artificial sequence
  Synthetic oligonucleotide
gctctttctagaacac

SEQ ID NO: 451 - DNA, 16 bp, Artificial sequence
  Synthetic oligonucleotide
tcatcagataatatct

SEQ ID NO: 452 - DNA, 16 bp, Artificial sequence
  Synthetic oligonucleotide
cctactcactgaattc

SEQ ID NO: 453 - DNA, 16 bp, Artificial sequence
  Synthetic oligonucleotide
taaatgaaggtaaacc

SEQ ID NO: 454 - DNA, 16 bp, Artificial sequence
  Synthetic oligonucleotide
gtgttcattacaaatg

SEQ ID NO: 455 - DNA, 16 bp, Artificial sequence
  Synthetic oligonucleotide
gcaagtcttgtaagta

SEQ ID NO: 456 - DNA, 16 bp, Artificial sequence
  Synthetic oligonucleotide
caaaaccttatagtat

SEQ ID NO: 457 - DNA, 16 bp, Artificial sequence
  Synthetic oligonucleotide
atcatgattatctcta

SEQ ID NO: 458 - DNA, 16 bp, Artificial sequence
  Synthetic oligonucleotide
agttaattcatgctcg

SEQ ID NO: 459 - DNA, 16 bp, Artificial sequence
  Synthetic oligonucleotide
aaacacagaggtgcta

SEQ ID NO: 460 - DNA, 16 bp, Artificial sequence
  Synthetic oligonucleotide
gttatgaacccttgaa

SEQ ID NO: 461 - DNA, 16 bp, Artificial sequence
  Synthetic oligonucleotide
gaagggccaaaatact

SEQ ID NO: 462 - DNA, 16 bp, Artificial sequence
  Synthetic oligonucleotide
gcactgaaagtactta

SEQ ID NO: 463 - DNA, 16 bp, Artificial sequence
  Synthetic oligonucleotide
ataaaagccttagagt

SEQ ID NO: 464 - DNA, 16 bp, Artificial sequence
  Synthetic oligonucleotide
actactctaaaactcc

SEQ ID NO: 465 - DNA, 16 bp, Artificial sequence
  Synthetic oligonucleotide
caacatgctatgtaat

SEQ ID NO: 466 - DNA, 16 bp, Artificial sequence
  Synthetic oligonucleotide
aatcttaatctgtggc

SEQ ID NO: 467 - DNA, 16 bp, Artificial sequence
  Synthetic oligonucleotide
aactttcccaccctcc

SEQ ID NO: 468 - DNA, 16 bp, Artificial sequence
  Synthetic oligonucleotide
gtttataaagttctct

SEQ ID NO: 469 - DNA, 16 bp, Artificial sequence
  Synthetic oligonucleotide
gtgactgaaactctag

SEQ ID NO: 470 - DNA, 16 bp, Artificial sequence
  Synthetic oligonucleotide
cacagtactgctacaa

SEQ ID NO: 471 - DNA, 16 bp, Artificial sequence
  Synthetic oligonucleotide
ttaggtctccttcagg

SEQ ID NO: 472 - DNA, 16 bp, Artificial sequence
  Synthetic oligonucleotide
ggacataaaacaagag

SEQ ID NO: 473 - DNA, 16 bp, Artificial sequence
  Synthetic oligonucleotide
gattataaaattggtt

SEQ ID NO: 474 - DNA, 16 bp, Artificial sequence
  Synthetic oligonucleotide
atgtgctccatcaacc

SEQ ID NO: 475 - DNA, 16 bp, Artificial sequence
  Synthetic oligonucleotide
gaaaagttattacaac

SEQ ID NO: 476 - DNA, 16 bp, Artificial sequence
  Synthetic oligonucleotide
tatttgtagcaaagtc

SEQ ID NO: 477 - DNA, 16 bp, Artificial sequence
  Synthetic oligonucleotide
cacaattaattactgt

SEQ ID NO: 478 - DNA, 16 bp, Artificial sequence
  Synthetic oligonucleotide
ccacttttgcaatgtt

SEQ ID NO: 479 - DNA, 16 bp, Artificial sequence
  Synthetic oligonucleotide
tttctcagatgtacca

SEQ ID NO: 480 - DNA, 16 bp, Artificial sequence
  Synthetic oligonucleotide
tactttttcaagatac

SEQ ID NO: 481 - DNA, 16 bp, Artificial sequence
  Synthetic oligonucleotide
ctcttacatctaaaac

SEQ ID NO: 482 - DNA, 16 bp, Artificial sequence
  Synthetic oligonucleotide
aaggtattacataaga

SEQ ID NO: 483 - DNA, 16 bp, Artificial sequence
  Synthetic oligonucleotide
cttttgggcaaagttc

SEQ ID NO: 484 - DNA, 16 bp, Artificial sequence
  Synthetic oligonucleotide
gactatacaacaggcc

SEQ ID NO: 485 - DNA, 16 bp, Artificial sequence
  Synthetic oligonucleotide
aagtgtttaggcaagc

SEQ ID NO: 486 - DNA, 16 bp, Artificial sequence
  Synthetic oligonucleotide
agttactactgtaatc

SEQ ID NO: 487 - DNA, 16 bp, Artificial sequence
  Synthetic oligonucleotide
tgtcagttatcctatc

SEQ ID NO: 488 - DNA, 16 bp, Artificial sequence
  Synthetic oligonucleotide
atagagattttccctc

SEQ ID NO: 489 - DNA, 16 bp, Artificial sequence
  Synthetic oligonucleotide
gcctgccgaagcagtt

SEQ ID NO: 490 - DNA, 16 bp, Artificial sequence
  Synthetic oligonucleotide
gctgaagccgagttca

SEQ ID NO: 491 - DNA, 16 bp, Artificial sequence
  Synthetic oligonucleotide
cgagtccccgcggacg

SEQ ID NO: 492 - DNA, 16 bp, Artificial sequence
  Synthetic oligonucleotide
ccgagtccccgcggac

SEQ ID NO: 493 - DNA, 16 bp, Artificial sequence
  Synthetic oligonucleotide
tccgagtccccgcgga

SEQ ID NO: 494 - DNA, 16 bp, Artificial sequence
  Synthetic oligonucleotide
tctccgagtccccgcg

SEQ ID NO: 495 - DNA, 16 bp, Artificial sequence
  Synthetic oligonucleotide
cggtctccgagtcccc

SEQ ID NO: 496 - DNA, 16 bp, Artificial sequence
  Synthetic oligonucleotide
tcggtctccgagtccc

SEQ ID NO: 497 - DNA, 16 bp, Artificial sequence
  Synthetic oligonucleotide
gtcggtctccgagtcc

SEQ ID NO: 498 - DNA, 16 bp, Artificial sequence
  Synthetic oligonucleotide
cgttggccgtcttggg

SEQ ID NO: 499 - DNA, 16 bp, Artificial sequence
  Synthetic oligonucleotide
ttgaagaaggagtcgg

SEQ ID NO: 500 - DNA, 16 bp, Artificial sequence
  Synthetic oligonucleotide
cggcttgaagaaggag

SEQ ID NO: 501 - DNA, 16 bp, Artificial sequence
  Synthetic oligonucleotide
ggcggcttgaagaagg

SEQ ID NO: 502 - DNA, 16 bp, Artificial sequence
  Synthetic oligonucleotide
tgcatcagtactggcc

SEQ ID NO: 503 - DNA, 16 bp, Artificial sequence
  Synthetic oligonucleotide
tcgaacatgctgtgga

SEQ ID NO: 504 - DNA, 16 bp, Artificial sequence
  Synthetic oligonucleotide
gctcgaacatgctgtg

SEQ ID NO: 505 - DNA, 16 bp, Artificial sequence
  Synthetic oligonucleotide
agctcgaacatgctgt

SEQ ID NO: 506 - DNA, 16 bp, Artificial sequence
  Synthetic oligonucleotide
tgagctcgaacatgct

SEQ ID NO: 507 - DNA, 16 bp, Artificial sequence
  Synthetic oligonucleotide
catgttgttgtctgat

SEQ ID NO: 508 - DNA, 16 bp, Artificial sequence
  Synthetic oligonucleotide
gccatgttgttgtctg

SEQ ID NO: 509 - DNA, 16 bp, Artificial sequence
  Synthetic oligonucleotide
tgtagctgctcatgct

SEQ ID NO: 510 - DNA, 16 bp, Artificial sequence
  Synthetic oligonucleotide
ctagcttggtggcagc

SEQ ID NO: 511 - DNA, 16 bp, Artificial sequence
  Synthetic oligonucleotide
atctagcttggtggca

SEQ ID NO: 512 - DNA, 16 bp, Artificial sequence
  Synthetic oligonucleotide
ttatctagcttggtgg

SEQ ID NO: 513 - DNA, 16 bp, Artificial sequence
  Synthetic oligonucleotide
ctttatctagcttggt

SEQ ID NO: 514 - DNA, 16 bp, Artificial sequence
  Synthetic oligonucleotide
accaactattacttca

SEQ ID NO: 515 - DNA, 16 bp, Artificial sequence
  Synthetic oligonucleotide
ggtgctagctggtgcc

SEQ ID NO: 516 - DNA, 16 bp, Artificial sequence
  Synthetic oligonucleotide
aggtgctagctggtgc

SEQ ID NO: 517 - DNA, 16 bp, Artificial sequence
  Synthetic oligonucleotide
cagaggtgctagctgg

SEQ ID NO: 518 - DNA, 16 bp, Artificial sequence
  Synthetic oligonucleotide
aaagccttagagtcaa

SEQ ID NO: 519 - DNA, 16 bp, Artificial sequence
  Synthetic oligonucleotide
ctgggattgatattcc

SEQ ID NO: 520 - DNA, 16 bp, Artificial sequence
  Synthetic oligonucleotide
gctgggattgatattc

SEQ ID NO: 521 - DNA, 16 bp, Artificial sequence
  Synthetic oligonucleotide
catcagtactggccta

SEQ ID NO: 522 - DNA, 16 bp, Artificial sequence
  Synthetic oligonucleotide
gcgcccgcccgcaccg

SEQ ID NO: 523 - DNA, 16 bp, Artificial sequence
  Synthetic oligonucleotide
cgcgcccgcccgcacc

SEQ ID NO: 524 - DNA, 16 bp, Artificial sequence
  Synthetic oligonucleotide
tcctctgcgcgcccgc

SEQ ID NO: 525 - DNA, 16 bp, Artificial sequence
  Synthetic oligonucleotide
ttcctctgcgcgcccg

SEQ ID NO: 526 - DNA, 16 bp, Artificial sequence
  Synthetic oligonucleotide
cttcctctgcgcgccc

SEQ ID NO: 527 - DNA, 16 bp, Artificial sequence
  Synthetic oligonucleotide
ccttcctctgcgcgcc

SEQ ID NO: 528 - DNA, 16 bp, Artificial sequence
  Synthetic oligonucleotide
gcgcgcgcattgtgca

SEQ ID NO: 529 - DNA, 16 bp, Artificial sequence
  Synthetic oligonucleotide
ggcgcgcgcattgtgc

SEQ ID NO: 530 - DNA, 16 bp, Artificial sequence
  Synthetic oligonucleotide
gaggcgcgcgcattgt

SEQ ID NO: 531 - DNA, 16 bp, Artificial sequence
  Synthetic oligonucleotide
ggaggcgcgcgcattg

SEQ ID NO: 532 - DNA, 16 bp, Artificial sequence
  Synthetic oligonucleotide
cggaggcgcgcgcatt

SEQ ID NO: 533 - DNA, 16 bp, Artificial sequence
  Synthetic oligonucleotide
gcgaaggtgcggagcg

SEQ ID NO: 534 - DNA, 16 bp, Artificial sequence
  Synthetic oligonucleotide
agcgaaggtgcggagc

SEQ ID NO: 535 - DNA, 16 bp, Artificial sequence
  Synthetic oligonucleotide
ctatgagtcaacctgc

SEQ ID NO: 536 - DNA, 16 bp, Artificial sequence
  Synthetic oligonucleotide
gcctatgagtcaacct

SEQ ID NO: 537 - DNA, 16 bp, Artificial sequence
  Synthetic oligonucleotide
ttgaaacctgatcctt

SEQ ID NO: 538 - DNA, 16 bp, Artificial sequence
  Synthetic oligonucleotide
ctaacaacctggtttg

SEQ ID NO: 539 - DNA, 16 bp, Artificial sequence
  Synthetic oligonucleotide
aggctattaagctgtt

SEQ ID NO: 540 - DNA, 16 bp, Artificial sequence
  Synthetic oligonucleotide
caggctattaagctgt

SEQ ID NO: 541 - DNA, 16 bp, Artificial sequence
  Synthetic oligonucleotide
gcaggctattaagctg

SEQ ID NO: 542 - DNA, 16 bp, Artificial sequence
  Synthetic oligonucleotide
gaccaactacttgaag

SEQ ID NO: 543 - DNA, 16 bp, Artificial sequence
  Synthetic oligonucleotide
ttgaccaactacttga

SEQ ID NO: 544 - DNA, 16 bp, Artificial sequence
  Synthetic oligonucleotide
agttattcagcagctt

SEQ ID NO: 545 - DNA, 16 bp, Artificial sequence
  Synthetic oligonucleotide
ctcttacacagcctag

SEQ ID NO: 546 - DNA, 16 bp, Artificial sequence
  Synthetic oligonucleotide
cagtttatgtagtagt

SEQ ID NO: 547 - DNA, 16 bp, Artificial sequence
  Synthetic oligonucleotide
gcacacaactcagaca

SEQ ID NO: 548 - DNA, 16 bp, Artificial sequence
  Synthetic oligonucleotide
ttatgggatgagtgct

SEQ ID NO: 549 - DNA, 16 bp, Artificial sequence
  Synthetic oligonucleotide
tttcagttatcggccc

SEQ ID NO: 550 - DNA, 16 bp, Artificial sequence
  Synthetic oligonucleotide
aatactgatctgcagc

SEQ ID NO: 551 - DNA, 16 bp, Artificial sequence
  Synthetic oligonucleotide
ctatatatggtagtct

SEQ ID NO: 552 - DNA, 16 bp, Artificial sequence
  Synthetic oligonucleotide
ttaccaaaacgagggt

SEQ ID NO: 553 - DNA, 16 bp, Artificial sequence
  Synthetic oligonucleotide
tttaccaaaacgaggg

SEQ ID NO: 554 - DNA, 16 bp, Artificial sequence
  Synthetic oligonucleotide
ctttaccaaaacgagg

SEQ ID NO: 555 - DNA, 16 bp, Artificial sequence
  Synthetic oligonucleotide
acctttaccaaaacga

SEQ ID NO: 556 - DNA, 16 bp, Artificial sequence
  Synthetic oligonucleotide
ctagtaatcttactgg

SEQ ID NO: 557 - DNA, 16 bp, Artificial sequence
  Synthetic oligonucleotide
cagaattcccaagcta

SEQ ID NO: 558 - DNA, 16 bp, Artificial sequence
  Synthetic oligonucleotide
ctgtgtaggctgactt

SEQ ID NO: 559 - DNA, 16 bp, Artificial sequence
  Synthetic oligonucleotide
gctgtgtaggctgact

SEQ ID NO: 560 - DNA, 16 bp, Artificial sequence
  Synthetic oligonucleotide
acggataaaaattact

SEQ ID NO: 561 - DNA, 16 bp, Artificial sequence
  Synthetic oligonucleotide
agagcctacctgacat

SEQ ID NO: 562 - DNA, 16 bp, Artificial sequence
  Synthetic oligonucleotide
taagagcctacctgac

SEQ ID NO: 563 - DNA, 16 bp, Artificial sequence
  Synthetic oligonucleotide
ttcataatctgactag

SEQ ID NO: 564 - DNA, 16 bp, Artificial sequence
  Synthetic oligonucleotide
ctccgtggtgatccca

SEQ ID NO: 565 - DNA, 16 bp, Artificial sequence
  Synthetic oligonucleotide
tttcttaaccagcgga

SEQ ID NO: 566 - DNA, 16 bp, Artificial sequence
  Synthetic oligonucleotide
gatcaacatgctaaca

SEQ ID NO: 567 - DNA, 16 bp, Artificial sequence
  Synthetic oligonucleotide
tcccttgacggaggcc

SEQ ID NO: 568 - DNA, 16 bp, Artificial sequence
  Synthetic oligonucleotide
gcgacggctgcgggcc

SEQ ID NO: 569 - DNA, 16 bp, Artificial sequence
  Synthetic oligonucleotide
cctgacccaggcgagc

SEQ ID NO: 570 - DNA, 16 bp, Artificial sequence
  Synthetic oligonucleotide
cacgatctgatgcccg

SEQ ID NO: 571 - DNA, 16 bp, Artificial sequence
  Synthetic oligonucleotide
ggccagagactactcc

SEQ ID NO: 572 - DNA, 16 bp, Artificial sequence
  Synthetic oligonucleotide
gccgaagcagttcttg

SEQ ID NO: 573 - DNA, 16 bp, Artificial sequence
  Synthetic oligonucleotide
gtcattaaggatgtca

SEQ ID NO: 574 - DNA, 16 bp, Artificial sequence
  Synthetic oligonucleotide
cttagatccttcacag

SEQ ID NO: 575 - DNA, 16 bp, Artificial sequence
  Synthetic oligonucleotide
ttccggtgcatgtgtc

SEQ ID NO: 576 - DNA, 16 bp, Artificial sequence
  Synthetic oligonucleotide
gcaactggcttatgga

SEQ ID NO: 577 - DNA, 16 bp, Artificial sequence
  Synthetic oligonucleotide
ttagagccaactgtga

SEQ ID NO: 578 - DNA, 16 bp, Artificial sequence
  Synthetic oligonucleotide
actaaatgctgtgaca

SEQ ID NO: 579 - DNA, 16 bp, Artificial sequence
  Synthetic oligonucleotide
ccttataagctcctaa

SEQ ID NO: 580 - DNA, 16 bp, Artificial sequence
  Synthetic oligonucleotide
tgcctaggttccgaca

SEQ ID NO: 581 - DNA, 16 bp, Artificial sequence
  Synthetic oligonucleotide
gcagataatcgagatt

SEQ ID NO: 582 - DNA, 16 bp, Artificial sequence
  Synthetic oligonucleotide
cactaccacactatta

SEQ ID NO: 583 - DNA, 16 bp, Artificial sequence
  Synthetic oligonucleotide
ctgcagactgccccaa

SEQ ID NO: 584 - DNA, 16 bp, Artificial sequence
  Synthetic oligonucleotide
ttccaattcatcagat

SEQ ID NO: 585 - DNA, 16 bp, Artificial sequence
  Synthetic oligonucleotide
agtaagaacaatcttg

SEQ ID NO: 586 - DNA, 16 bp, Artificial sequence
  Synthetic oligonucleotide
gtaggagcaagtcttg

SEQ ID NO: 587 - DNA, 16 bp, Artificial sequence
  Synthetic oligonucleotide
agggtcaattttcagc

SEQ ID NO: 588 - DNA, 16 bp, Artificial sequence
  Synthetic oligonucleotide
gtattctatccagggt

SEQ ID NO: 589 - DNA, 16 bp, Artificial sequence
  Synthetic oligonucleotide
catactctagttacat

SEQ ID NO: 590 - DNA, 16 bp, Artificial sequence
  Synthetic oligonucleotide
ctcctgtagacacata

SEQ ID NO: 591 - DNA, 16 bp, Artificial sequence
  Synthetic oligonucleotide
caaccaactattactt

SEQ ID NO: 592 - DNA, 16 bp, Artificial sequence
  Synthetic oligonucleotide
acacagaggtgctagc

SEQ ID NO: 593 - DNA, 16 bp, Artificial sequence
  Synthetic oligonucleotide
acctatgaactattat

SEQ ID NO: 594 - DNA, 16 bp, Artificial sequence
  Synthetic oligonucleotide
caacaacatgctatgt

SEQ ID NO: 595 - DNA, 16 bp, Artificial sequence
  Synthetic oligonucleotide
gtggctactggcaaat

SEQ ID NO: 596 - DNA, 16 bp, Artificial sequence
  Synthetic oligonucleotide
ctgctgatatataaga

SEQ ID NO: 597 - DNA, 16 bp, Artificial sequence
  Synthetic oligonucleotide
ggcagcacggtgtaag

SEQ ID NO: 598 - DNA, 16 bp, Artificial sequence
  Synthetic oligonucleotide
tcacagtactgctaca

SEQ ID NO: 599 - DNA, 16 bp, Artificial sequence
  Synthetic oligonucleotide
agcagttaagcacttt

SEQ ID NO: 600 - DNA, 16 bp, Artificial sequence
  Synthetic oligonucleotide
cctttaaaggcactac

SEQ ID NO: 601 - DNA, 16 bp, Artificial sequence
  Synthetic oligonucleotide
tccacctgagcactca

SEQ ID NO: 602 - DNA, 16 bp, Artificial sequence
  Synthetic oligonucleotide
gagcatgctcttacat

SEQ ID NO: 603 - DNA, 16 bp, Artificial sequence
  Synthetic oligonucleotide
ggtggtcttgttctta

SEQ ID NO: 604 - DNA, 16 bp, Artificial sequence
  Synthetic oligonucleotide
aacgagggtcaagcct

SEQ ID NO: 605 - DNA, 16 bp, Artificial sequence
  Synthetic oligonucleotide
tgggcaaagttcctat

SEQ ID NO: 606 - DNA, 16 bp, Artificial sequence
  Synthetic oligonucleotide
tgcaaataggagaggg

SEQ ID NO: 607 - DNA, 16 bp, Artificial sequence
  Synthetic oligonucleotide
ccgcaccgcggcccgg

SEQ ID NO: 608 - DNA, 16 bp, Artificial sequence
  Synthetic oligonucleotide
agctacagagcttaac

SEQ ID NO: 609 - DNA, 16 bp, Artificial sequence
  Synthetic oligonucleotide
tattatatggctaagc

SEQ ID NO: 610 - DNA, 16 bp, Artificial sequence
  Synthetic oligonucleotide
aactaaagaggactta

SEQ ID NO: 611 - DNA, 16 bp, Artificial sequence
  Synthetic oligonucleotide
acgcaatctgtgatcc

SEQ ID NO: 612 - DNA, 16 bp, Artificial sequence
  Synthetic oligonucleotide
tgccgttggcccctcc

SEQ ID NO: 613 - DNA, 16 bp, Artificial sequence
  Synthetic oligonucleotide
gaaaagggcaatcata

SEQ ID NO: 614 - DNA, 16 bp, Artificial sequence
  Synthetic oligonucleotide
cattatatggcaccca

SEQ ID NO: 615 - DNA, 16 bp, Artificial sequence
  Synthetic oligonucleotide
gaacttagttccctat

SEQ ID NO: 616 - DNA, 16 bp, Artificial sequence
  Synthetic oligonucleotide
aattaacacctgagct

SEQ ID NO: 617 - DNA, 16 bp, Artificial sequence
  Synthetic oligonucleotide
cgcaatatagtctata

SEQ ID NO: 618 - DNA, 16 bp, Artificial sequence
  Synthetic oligonucleotide
tcagttggcaacagtc

SEQ ID NO: 619 - DNA, 16 bp, Artificial sequence
  Synthetic oligonucleotide
gcatactacactataa

SEQ ID NO: 620 - DNA, 16 bp, Artificial sequence
  Synthetic oligonucleotide
ttaaactaggcacatt

SEQ ID NO: 621 - DNA, 16 bp, Artificial sequence
  Synthetic oligonucleotide
tcgcatggccactgcc

SEQ ID NO: 622 - DNA, 16 bp, Artificial sequence
  Synthetic oligonucleotide
ccaaataaggatctgt

SEQ ID NO: 623 - DNA, 16 bp, Artificial sequence
  Synthetic oligonucleotide
atggactgtatgcagc

SEQ ID NO: 624 - DNA, 16 bp, Artificial sequence
  Synthetic oligonucleotide
gtagtataatgagtta

SEQ ID NO: 625 - DNA, 16 bp, Artificial sequence
  Synthetic oligonucleotide
ctgtcagttatcctat

SEQ ID NO: 626 - DNA, 16 bp, Artificial sequence
  Synthetic oligonucleotide
gctctgtcagttatcc

SEQ ID NO: 627 - DNA, 16 bp, Artificial sequence
  Synthetic oligonucleotide
gtgatatggattctgt

SEQ ID NO: 628 - DNA, 16 bp, Artificial sequence
  Synthetic oligonucleotide
gttactgcaactgccc

SEQ ID NO: 629 - DNA, 16 bp, Artificial sequence
  Synthetic oligonucleotide
gttatcctctatagtc

SEQ ID NO: 630 - DNA, 16 bp, Artificial sequence
  Synthetic oligonucleotide
tcaatgcaggattcca

SEQ ID NO: 631 - DNA, 16 bp, Artificial sequence
  Synthetic oligonucleotide
gtgttgcatgacagcc

SEQ ID NO: 632 - DNA, 16 bp, Artificial sequence
  Synthetic oligonucleotide
agtctcaacaaccttc

SEQ ID NO: 633 - DNA, 16 bp, Artificial sequence
  Synthetic oligonucleotide
taacatatgtctactc

SEQ ID NO: 634 - DNA, 16 bp, Artificial sequence
  Synthetic oligonucleotide
ctacagacgaattcca

SEQ ID NO: 635 - DNA, 16 bp, Artificial sequence
  Synthetic oligonucleotide
ggtactctccttcaga

SEQ ID NO: 636 - DNA, 16 bp, Artificial sequence
  Synthetic oligonucleotide
gtcatctatgtgtcct

SEQ ID NO: 637 - DNA, 16 bp, Artificial sequence
  Synthetic oligonucleotide
tatgtcctactttccc

SEQ ID NO: 638 - DNA, 16 bp, Artificial sequence
  Synthetic oligonucleotide
cataagaaaagacgac

SEQ ID NO: 639 - DNA, 16 bp, Artificial sequence
  Synthetic oligonucleotide
attatatggttgcttc

SEQ ID NO: 640 - DNA, 16 bp, Artificial sequence
  Synthetic oligonucleotide
cgctagcacgcgcgct

SEQ ID NO: 641 - DNA, 16 bp, Artificial sequence
  Synthetic oligonucleotide
tgcctagggttctgtg

SEQ ID NO: 642 - DNA, 16 bp, Artificial sequence
  Synthetic oligonucleotide
cactgaggcacggccc

SEQ ID NO: 643 - DNA, 16 bp, Artificial sequence
  Synthetic oligonucleotide
gtgataacatatccca

SEQ ID NO: 644 - DNA, 16 bp, Artificial sequence
  Synthetic oligonucleotide
aggcactcggacctgc

SEQ ID NO: 645 - DNA, 16 bp, Artificial sequence
  Synthetic oligonucleotide
ggagaagcggcgacgg

SEQ ID NO: 646 - DNA, 16 bp, Artificial sequence
  Synthetic oligonucleotide
gttgaggcggcggctg

SEQ ID NO: 647 - DNA, 16 bp, Artificial sequence
  Synthetic oligonucleotide
ctccaggtcggtctcc

SEQ ID NO: 648 - DNA, 16 bp, Artificial sequence
  Synthetic oligonucleotide
gtcgaagatgctgagc

SEQ ID NO: 649 - DNA, 16 bp, Artificial sequence
  Synthetic oligonucleotide
actggctacgcagggc

SEQ ID NO: 650 - DNA, 16 bp, Artificial sequence
  Synthetic oligonucleotide
ggtggcagccaaaaca

SEQ ID NO: 651 - DNA, 16 bp, Artificial sequence
  Synthetic oligonucleotide
tccttagatccttcac

SEQ ID NO: 652 - DNA, 16 bp, Artificial sequence
  Synthetic oligonucleotide
atttccggtgcatgtg

SEQ ID NO: 653 - DNA, 16 bp, Artificial sequence
  Synthetic oligonucleotide
tctgtattagcctgaa

SEQ ID NO: 654 - DNA, 16 bp, Artificial sequence
  Synthetic oligonucleotide
tccaaacaggctcact

SEQ ID NO: 655 - DNA, 16 bp, Artificial sequence
  Synthetic oligonucleotide
tgtcagaccagtaaat

SEQ ID NO: 656 - DNA, 16 bp, Artificial sequence
  Synthetic oligonucleotide
atatggaaattgtctc

SEQ ID NO: 657 - DNA, 16 bp, Artificial sequence
  Synthetic oligonucleotide
ctattaacagattcac

SEQ ID NO: 658 - DNA, 16 bp, Artificial sequence
  Synthetic oligonucleotide
gagcagataatcgaga

SEQ ID NO: 659 - DNA, 16 bp, Artificial sequence
  Synthetic oligonucleotide
cattccactaccacac

SEQ ID NO: 660 - DNA, 16 bp, Artificial sequence
  Synthetic oligonucleotide
tctagaacactaaact

SEQ ID NO: 661 - DNA, 16 bp, Artificial sequence
  Synthetic oligonucleotide
aattagtccaagggag

SEQ ID NO: 662 - DNA, 16 bp, Artificial sequence
  Synthetic oligonucleotide
gtaagtaagaacaatc

SEQ ID NO: 663 - DNA, 16 bp, Artificial sequence
  Synthetic oligonucleotide
gaagtaggagcaagtc

SEQ ID NO: 664 - DNA, 16 bp, Artificial sequence
  Synthetic oligonucleotide
cagggtcaattttcag

SEQ ID NO: 665 - DNA, 16 bp, Artificial sequence
  Synthetic oligonucleotide
tatagtattctatcca

SEQ ID NO: 666 - DNA, 16 bp, Artificial sequence
  Synthetic oligonucleotide
cacatactctagttac

SEQ ID NO: 667 - DNA, 16 bp, Artificial sequence
  Synthetic oligonucleotide
tattactcctgtagac

SEQ ID NO: 668 - DNA, 16 bp, Artificial sequence
  Synthetic oligonucleotide
cacaaccaactattac

SEQ ID NO: 669 - DNA, 16 bp, Artificial sequence
  Synthetic oligonucleotide
cattgaaagaccctta

SEQ ID NO: 670 - DNA, 16 bp, Artificial sequence
  Synthetic oligonucleotide
tcaacctatgaactat

SEQ ID NO: 671 - DNA, 16 bp, Artificial sequence
  Synthetic oligonucleotide
attataggcactcctt

SEQ ID NO: 672 - DNA, 16 bp, Artificial sequence
  Synthetic oligonucleotide
tctgtggctactggca

SEQ ID NO: 673 - DNA, 16 bp, Artificial sequence
  Synthetic oligonucleotide
aatctgctgatatata

SEQ ID NO: 674 - DNA, 16 bp, Artificial sequence
  Synthetic oligonucleotide
ggtgactgaaactcta

SEQ ID NO: 675 - DNA, 16 bp, Artificial sequence
  Synthetic oligonucleotide
cgtaagatcaaagcac

SEQ ID NO: 676 - DNA, 16 bp, Artificial sequence
  Synthetic oligonucleotide
cccaatacaaccaaga

SEQ ID NO: 677 - DNA, 16 bp, Artificial sequence
  Synthetic oligonucleotide
tgccatgttccatata

SEQ ID NO: 678 - DNA, 16 bp, Artificial sequence
  Synthetic oligonucleotide
caacatgcttgcgagg

SEQ ID NO: 679 - DNA, 16 bp, Artificial sequence
  Synthetic oligonucleotide
acctaacatatgagca

SEQ ID NO: 680 - DNA, 16 bp, Artificial sequence
  Synthetic oligonucleotide
gaggtggtcttgttct

SEQ ID NO: 681 - DNA, 16 bp, Artificial sequence
  Synthetic oligonucleotide
gatattccgcattgcc

SEQ ID NO: 682 - DNA, 16 bp, Artificial sequence
  Synthetic oligonucleotide
ttgggcaaagttccta

SEQ ID NO: 683 - DNA, 16 bp, Artificial sequence
  Synthetic oligonucleotide
ctccgacaggagacta

SEQ ID NO: 684 - DNA, 16 bp, Artificial sequence
  Synthetic oligonucleotide
ccgcagagagaaactc

SEQ ID NO: 685 - DNA, 16 bp, Artificial sequence
  Synthetic oligonucleotide
gacatcaatttcagtc

SEQ ID NO: 686 - DNA, 16 bp, Artificial sequence
  Synthetic oligonucleotide
taggaagttgttgacc

SEQ ID NO: 687 - DNA, 16 bp, Artificial sequence
  Synthetic oligonucleotide
gctacgacggctggcc

SEQ ID NO: 688 - DNA, 16 bp, Artificial sequence
  Synthetic oligonucleotide
cagtataatatcctaa

SEQ ID NO: 689 - DNA, 16 bp, Artificial sequence
  Synthetic oligonucleotide
gaacagataggactac

SEQ ID NO: 690 - DNA, 16 bp, Artificial sequence
  Synthetic oligonucleotide
tgccgggcccctatgc

SEQ ID NO: 691 - DNA, 16 bp, Artificial sequence
  Synthetic oligonucleotide
gaacttagttcccttc

SEQ ID NO: 692 - DNA, 16 bp, Artificial sequence
  Synthetic oligonucleotide
agaacttagttcccta

SEQ ID NO: 693 - DNA, 16 bp, Artificial sequence
  Synthetic oligonucleotide
ccatgagggactccca

SEQ ID NO: 694 - DNA, 16 bp, Artificial sequence
  Synthetic oligonucleotide
acactatgtgttctgc

SEQ ID NO: 695 - DNA, 16 bp, Artificial sequence
  Synthetic oligonucleotide
ggctagaggccgggtg

SEQ ID NO: 696 - DNA, 16 bp, Artificial sequence
  Synthetic oligonucleotide
ctaaagatgactactg

SEQ ID NO: 697 - DNA, 16 bp, Artificial sequence
  Synthetic oligonucleotide
tgatgtcttgtccaga

SEQ ID NO: 698 - DNA, 16 bp, Artificial sequence
  Synthetic oligonucleotide
tcaatgctgtatcaga

SEQ ID NO: 699 - DNA, 16 bp, Artificial sequence
  Synthetic oligonucleotide
ttatataggttacaga

SEQ ID NO: 700 - DNA, 16 bp, Artificial sequence
  Synthetic oligonucleotide
aataatatagcttacg

SEQ ID NO: 701 - DNA, 16 bp, Artificial sequence
  Synthetic oligonucleotide
cataataggacacaac

SEQ ID NO: 702 - DNA, 16 bp, Artificial sequence
  Synthetic oligonucleotide
atctgtcagttatcct

SEQ ID NO: 703 - DNA, 16 bp, Artificial sequence
  Synthetic oligonucleotide
agcacggtgtagcttt

SEQ ID NO: 704 - DNA, 16 bp, Artificial sequence
  Synthetic oligonucleotide
ggaatacaagcccgag

SEQ ID NO: 705 - DNA, 16 bp, Artificial sequence
  Synthetic oligonucleotide
agcaatatggtattag

SEQ ID NO: 706 - DNA, 16 bp, Artificial sequence
  Synthetic oligonucleotide
gtaaagagggtgacat

SEQ ID NO: 707 - DNA, 16 bp, Artificial sequence
  Synthetic oligonucleotide
gaatttttagtccagt

SEQ ID NO: 708 - DNA, 16 bp, Artificial sequence
  Synthetic oligonucleotide
gtgatctgcacattgt

SEQ ID NO: 709 - DNA, 16 bp, Artificial sequence
  Synthetic oligonucleotide
gattagaggactcatt

SEQ ID NO: 710 - DNA, 16 bp, Artificial sequence
  Synthetic oligonucleotide
acgaataaggcattag

SEQ ID NO: 711 - DNA, 16 bp, Artificial sequence
  Synthetic oligonucleotide
caacaaacatagttac

SEQ ID NO: 712 - DNA, 16 bp, Artificial sequence
  Synthetic oligonucleotide
gtaactgtttctaggt

SEQ ID NO: 713 - DNA, 16 bp, Artificial sequence
  Synthetic oligonucleotide
atggtctcccagtcac

SEQ ID NO: 714 - DNA, 16 bp, Artificial sequence
  Synthetic oligonucleotide
tgggcaaagttcctct

SEQ ID NO: 715 - DNA, 16 bp, Artificial sequence
  Synthetic oligonucleotide
gccaatggagtcacca

SEQ ID NO: 716 - DNA, 16 bp, Artificial sequence
  Synthetic oligonucleotide
acgagcacagcaccct

SEQ ID NO: 717 - DNA, 16 bp, Artificial sequence
  Synthetic oligonucleotide
agataatcatcctcaa

SEQ ID NO: 718 - DNA, 16 bp, Artificial sequence
  Synthetic oligonucleotide
tcattgtagtctgtct

SEQ ID NO: 719 - DNA, 16 bp, Artificial sequence
  Synthetic oligonucleotide
tactataagacaccaa

SEQ ID NO: 720 - DNA, 16 bp, Artificial sequence
  Synthetic oligonucleotide
tgccaggtaagccaca

SEQ ID NO: 721 - DNA, 16 bp, Artificial sequence
  Synthetic oligonucleotide
cgccccggctccactg

SEQ ID NO: 722 - DNA, 16 bp, Artificial sequence
  Synthetic oligonucleotide
ctccacgggccgaggt

SEQ ID NO: 723 - DNA, 16 bp, Artificial sequence
  Synthetic oligonucleotide
gcgaaggcggctgccc

SEQ ID NO: 724 - DNA, 16 bp, Artificial sequence
  Synthetic oligonucleotide
gcctcatgggcacggt

SEQ ID NO: 725 - DNA, 16 bp, Artificial sequence
  Synthetic oligonucleotide
gttcatctgggacagc

SEQ ID NO: 726 - DNA, 16 bp, Artificial sequence
  Synthetic oligonucleotide
cctgagacatcccggg

SEQ ID NO: 727 - DNA, 16 bp, Artificial sequence
  Synthetic oligonucleotide
ttggtggcagccaaaa

SEQ ID NO: 728 - DNA, 16 bp, Artificial sequence
  Synthetic oligonucleotide
gtctccttagatcctt

SEQ ID NO: 729 - DNA, 16 bp, Artificial sequence
  Synthetic oligonucleotide
ggaaatttccggtgca

SEQ ID NO: 730 - DNA, 16 bp, Artificial sequence
  Synthetic oligonucleotide
gaggattaaagtatct

SEQ ID NO: 731 - DNA, 16 bp, Artificial sequence
  Synthetic oligonucleotide
aggaatggcatccatc

SEQ ID NO: 732 - DNA, 16 bp, Artificial sequence
  Synthetic oligonucleotide
aaacagtcttcagcct

SEQ ID NO: 733 - DNA, 16 bp, Artificial sequence
  Synthetic oligonucleotide
gagtatgtggcaataa

SEQ ID NO: 734 - DNA, 16 bp, Artificial sequence
  Synthetic oligonucleotide
aaccatcccaagctac

SEQ ID NO: 735 - DNA, 16 bp, Artificial sequence
  Synthetic oligonucleotide
gagagcagataatcga

SEQ ID NO: 736 - DNA, 16 bp, Artificial sequence
  Synthetic oligonucleotide
gcgctaccattttaaa

SEQ ID NO: 737 - DNA, 16 bp, Artificial sequence
  Synthetic oligonucleotide
ccacagtaatagctct

SEQ ID NO: 738 - DNA, 16 bp, Artificial sequence
  Synthetic oligonucleotide
ttccaatcgagactta

SEQ ID NO: 739 - DNA, 16 bp, Artificial sequence
  Synthetic oligonucleotide
agtcttgtaagtaaga

SEQ ID NO: 740 - DNA, 16 bp, Artificial sequence
  Synthetic oligonucleotide
gcatagaagtaggagc

SEQ ID NO: 741 - DNA, 16 bp, Artificial sequence
  Synthetic oligonucleotide
atccagggtcaatttt

SEQ ID NO: 742 - DNA, 16 bp, Artificial sequence
  Synthetic oligonucleotide
accttatagtattcta

SEQ ID NO: 743 - DNA, 16 bp, Artificial sequence
  Synthetic oligonucleotide
gacacatactctagtt

SEQ ID NO: 744 - DNA, 16 bp, Artificial sequence
  Synthetic oligonucleotide
ccattattactcctgt

SEQ ID NO: 745 - DNA, 16 bp, Artificial sequence
  Synthetic oligonucleotide
ttcacaaccaactatt

SEQ ID NO: 746 - DNA, 16 bp, Artificial sequence
  Synthetic oligonucleotide
agcttttgccaggaga

SEQ ID NO: 747 - DNA, 16 bp, Artificial sequence
  Synthetic oligonucleotide
tatgagtgatcaacct

SEQ ID NO: 748 - DNA, 16 bp, Artificial sequence
  Synthetic oligonucleotide
ggcaaattataggcac

SEQ ID NO: 749 - DNA, 16 bp, Artificial sequence
  Synthetic oligonucleotide
cttaatctgtggctac

SEQ ID NO: 750 - DNA, 16 bp, Artificial sequence
  Synthetic oligonucleotide
agctaatctgctgata

SEQ ID NO: 751 - DNA, 16 bp, Artificial sequence
  Synthetic oligonucleotide
gtgtacttaggtgact

SEQ ID NO: 752 - DNA, 16 bp, Artificial sequence
  Synthetic oligonucleotide
ggtcagtacagagggc

SEQ ID NO: 753 - DNA, 16 bp, Artificial sequence
  Synthetic oligonucleotide
cccaatgctacccaat

SEQ ID NO: 754 - DNA, 16 bp, Artificial sequence
  Synthetic oligonucleotide
tggtatgaattctgaa

SEQ ID NO: 755 - DNA, 16 bp, Artificial sequence
  Synthetic oligonucleotide
tgataggcacacccac

SEQ ID NO: 756 - DNA, 16 bp, Artificial sequence
  Synthetic oligonucleotide
cctgaagccgagttca

SEQ ID NO: 757 - DNA, 16 bp, Artificial sequence
  Synthetic oligonucleotide
agccaagaggtggtct

SEQ ID NO: 758 - DNA, 16 bp, Artificial sequence
  Synthetic oligonucleotide
ttgatattccgcattg

SEQ ID NO: 759 - DNA, 16 bp, Artificial sequence
  Synthetic oligonucleotide
gctaactacattgcag

SEQ ID NO: 760 - DNA, 16 bp, Artificial sequence
  Synthetic oligonucleotide
tgtcatcaggttaagt

SEQ ID NO: 761 - DNA, 16 bp, Artificial sequence
  Synthetic oligonucleotide
gtgcggagcgcgcgga

SEQ ID NO: 762 - DNA, 16 bp, Artificial sequence
  Synthetic oligonucleotide
tagcaacccaccctgg

SEQ ID NO: 763 - DNA, 16 bp, Artificial sequence
  Synthetic oligonucleotide
gaatactgagtcagga

SEQ ID NO: 764 - DNA, 16 bp, Artificial sequence
  Synthetic oligonucleotide
ttacacacaggctatg

SEQ ID NO: 765 - DNA, 16 bp, Artificial sequence
  Synthetic oligonucleotide
acagtataatatccta

SEQ ID NO: 766 - DNA, 16 bp, Artificial sequence
  Synthetic oligonucleotide
ctattagggactgaac

SEQ ID NO: 767 - DNA, 16 bp, Artificial sequence
  Synthetic oligonucleotide
gtgatctgtgagaggt

SEQ ID NO: 768 - DNA, 16 bp, Artificial sequence
  Synthetic oligonucleotide
agaacttagttccctt

SEQ ID NO: 769 - DNA, 16 bp, Artificial sequence
  Synthetic oligonucleotide
ggaggagtcaccatgg

SEQ ID NO: 770 - DNA, 16 bp, Artificial sequence
  Synthetic oligonucleotide
tattgtgctgcatctc

SEQ ID NO: 771 - DNA, 16 bp, Artificial sequence
  Synthetic oligonucleotide
ggctatgtagccttcc

SEQ ID NO: 772 - DNA, 16 bp, Artificial sequence
  Synthetic oligonucleotide
gtggtgtctcacaggc

SEQ ID NO: 773 - DNA, 16 bp, Artificial sequence
  Synthetic oligonucleotide
cttattagccctcaaa

SEQ ID NO: 774 - DNA, 16 bp, Artificial sequence
  Synthetic oligonucleotide
gataactaagcactac

SEQ ID NO: 775 - DNA, 16 bp, Artificial sequence
  Synthetic oligonucleotide
atgtcagatgtcaatt

SEQ ID NO: 776 - DNA, 16 bp, Artificial sequence
  Synthetic oligonucleotide
tgctagaggctgttcc

SEQ ID NO: 777 - DNA, 16 bp, Artificial sequence
  Synthetic oligonucleotide
gaacactatagcttgg

SEQ ID NO: 778 - DNA, 16 bp, Artificial sequence
  Synthetic oligonucleotide
aacccactaaaaccgg

SEQ ID NO: 779 - DNA, 16 bp, Artificial sequence
  Synthetic oligonucleotide
tatctgtcagttatcc

SEQ ID NO: 780 - DNA, 16 bp, Artificial sequence
  Synthetic oligonucleotide
taatagactagactta

SEQ ID NO: 781 - DNA, 16 bp, Artificial sequence
  Synthetic oligonucleotide
tctatatgtttccccc

SEQ ID NO: 782 - DNA, 16 bp, Artificial sequence
  Synthetic oligonucleotide
gactataaagggttta

SEQ ID NO: 783 - DNA, 16 bp, Artificial sequence
  Synthetic oligonucleotide
acatgtgacattccgg

SEQ ID NO: 784 - DNA, 16 bp, Artificial sequence
  Synthetic oligonucleotide
tgtatatgccgttccc

SEQ ID NO: 785 - DNA, 16 bp, Artificial sequence
  Synthetic oligonucleotide
ctattcagtgatctgc

SEQ ID NO: 786 - DNA, 16 bp, Artificial sequence
  Synthetic oligonucleotide
cacaatacaagatgca

SEQ ID NO: 787 - DNA, 16 bp, Artificial sequence
  Synthetic oligonucleotide
gtgcaagcaggttccc

SEQ ID NO: 788 - DNA, 16 bp, Artificial sequence
  Synthetic oligonucleotide
agctggtagggcaaga

SEQ ID NO: 789 - DNA, 16 bp, Artificial sequence
  Synthetic oligonucleotide
gctacctggagcgaag

SEQ ID NO: 790 - DNA, 16 bp, Artificial sequence
  Synthetic oligonucleotide
tgatctgatgcttgct

SEQ ID NO: 791 - DNA, 16 bp, Artificial sequence
  Synthetic oligonucleotide
ctgggcaaagttcctc

SEQ ID NO: 792 - DNA, 16 bp, Artificial sequence
  Synthetic oligonucleotide
ccgcattgcctaagag

SEQ ID NO: 793 - DNA, 16 bp, Artificial sequence
  Synthetic oligonucleotide
tgcagtataatatcct

SEQ ID NO: 794 - DNA, 16 bp, Artificial sequence
  Synthetic oligonucleotide
gataatcatcctcagc

SEQ ID NO: 795 - DNA, 16 bp, Artificial sequence
  Synthetic oligonucleotide
agcgattggcctccca

SEQ ID NO: 796 - DNA, 16 bp, Artificial sequence
  Synthetic oligonucleotide
ttacagagagattcat

SEQ ID NO: 797 - DNA, 16 bp, Artificial sequence
  Synthetic oligonucleotide
gttgtcaactctaggg

SEQ ID NO: 798 - DNA, 16 bp, Artificial sequence
  Synthetic oligonucleotide
gcgccccggctccact

SEQ ID NO: 799 - DNA, 16 bp, Artificial sequence
  Synthetic oligonucleotide
acgccccggctccacg

SEQ ID NO: 800 - DNA, 16 bp, Artificial sequence
  Synthetic oligonucleotide
ccggacggcgggccct

SEQ ID NO: 801 - DNA, 16 bp, Artificial sequence
  Synthetic oligonucleotide
ggaatgagctcgaaca

SEQ ID NO: 802 - DNA, 16 bp, Artificial sequence
  Synthetic oligonucleotide
ctgaagccgagttcat

SEQ ID NO: 803 - DNA, 16 bp, Artificial sequence
  Synthetic oligonucleotide
gctcatgcttagtcca

SEQ ID NO: 804 - DNA, 16 bp, Artificial sequence
  Synthetic oligonucleotide
ggctctataaccatgt

SEQ ID NO: 805 - DNA, 16 bp, Artificial sequence
  Synthetic oligonucleotide
gtgtctccttagatcc

SEQ ID NO: 806 - DNA, 16 bp, Artificial sequence
  Synthetic oligonucleotide
atggaaatttccggtg

SEQ ID NO: 807 - DNA, 16 bp, Artificial sequence
  Synthetic oligonucleotide
gcagcaatggacaagg

SEQ ID NO: 808 - DNA, 16 bp, Artificial sequence
  Synthetic oligonucleotide
ttctaagtctgagtat

SEQ ID NO: 809 - DNA, 16 bp, Artificial sequence
  Synthetic oligonucleotide
tagcactaggaggaaa

SEQ ID NO: 810 - DNA, 16 bp, Artificial sequence
  Synthetic oligonucleotide
attagagtatgtggca

SEQ ID NO: 811 - DNA, 16 bp, Artificial sequence
  Synthetic oligonucleotide
atcgagatttaaataa

SEQ ID NO: 812 - DNA, 16 bp, Artificial sequence
  Synthetic oligonucleotide
atgttatgtttgggtg

SEQ ID NO: 813 - DNA, 16 bp, Artificial sequence
  Synthetic oligonucleotide
tactagtcatgtattc

SEQ ID NO: 814 - DNA, 16 bp, Artificial sequence
  Synthetic oligonucleotide
cccctaggcactatcc

SEQ ID NO: 815 - DNA, 16 bp, Artificial sequence
  Synthetic oligonucleotide
gcacattatgaaccta

SEQ ID NO: 816 - DNA, 16 bp, Artificial sequence
  Synthetic oligonucleotide
caagtcttgtaagtaa

SEQ ID NO: 817 - DNA, 16 bp, Artificial sequence
  Synthetic oligonucleotide
ttcagcatagaagtag

SEQ ID NO: 818 - DNA, 16 bp, Artificial sequence
  Synthetic oligonucleotide
tctatccagggtcaat

SEQ ID NO: 819 - DNA, 16 bp, Artificial sequence
  Synthetic oligonucleotide
gctaaattcaactacc

SEQ ID NO: 820 - DNA, 16 bp, Artificial sequence
  Synthetic oligonucleotide
tgtagacacatactct

SEQ ID NO: 821 - DNA, 16 bp, Artificial sequence
  Synthetic oligonucleotide
aaccattattactcct

SEQ ID NO: 822 - DNA, 16 bp, Artificial sequence
  Synthetic oligonucleotide
aattcacaaccaacta

SEQ ID NO: 823 - DNA, 16 bp, Artificial sequence
  Synthetic oligonucleotide
tccaaattgaagggcc

SEQ ID NO: 824 - DNA, 16 bp, Artificial sequence
  Synthetic oligonucleotide
agccttagagtcaatt

SEQ ID NO: 825 - DNA, 16 bp, Artificial sequence
  Synthetic oligonucleotide
ctggcaaattataggc

SEQ ID NO: 826 - DNA, 16 bp, Artificial sequence
  Synthetic oligonucleotide
atcttaatctgtggct

SEQ ID NO: 827 - DNA, 16 bp, Artificial sequence
  Synthetic oligonucleotide
ccctaagctaaagcta

SEQ ID NO: 828 - DNA, 16 bp, Artificial sequence
  Synthetic oligonucleotide
gtaaaggaagatctcc

SEQ ID NO: 829 - DNA, 16 bp, Artificial sequence
  Synthetic oligonucleotide
ctcttaggtctccttc

SEQ ID NO: 830 - DNA, 16 bp, Artificial sequence
  Synthetic oligonucleotide
ttcaagaatacccagt

SEQ ID NO: 831 - DNA, 16 bp, Artificial sequence
  Synthetic oligonucleotide
acgctagaaaagtgtt

SEQ ID NO: 832 - DNA, 16 bp, Artificial sequence
  Synthetic oligonucleotide
tgacaagtgtgcatta

SEQ ID NO: 833 - DNA, 16 bp, Artificial sequence
  Synthetic oligonucleotide
gtcttgttcttatggt

SEQ ID NO: 834 - DNA, 16 bp, Artificial sequence
  Synthetic oligonucleotide
tgggtctagccaagag

SEQ ID NO: 835 - DNA, 16 bp, Artificial sequence
  Synthetic oligonucleotide
gggattgatattccgc

SEQ ID NO: 836 - DNA, 16 bp, Artificial sequence
  Synthetic oligonucleotide
cccgagtgggctaact

SEQ ID NO: 837 - DNA, 16 bp, Artificial sequence
  Synthetic oligonucleotide
tccttaacccgggttt

SEQ ID NO: 838 - DNA, 16 bp, Artificial sequence
  Synthetic oligonucleotide
gttatgggtgcttttc

SEQ ID NO: 839 - DNA, 16 bp, Artificial sequence
  Synthetic oligonucleotide
atgatcaaaccttttc

SEQ ID NO: 840 - DNA, 16 bp, Artificial sequence
  Synthetic oligonucleotide
tgccactggtgaatac

SEQ ID NO: 841 - DNA, 16 bp, Artificial sequence
  Synthetic oligonucleotide
aatggagtggccgggc

SEQ ID NO: 842 - DNA, 16 bp, Artificial sequence
  Synthetic oligonucleotide
gttgtattactctcca

SEQ ID NO: 843 - DNA, 16 bp, Artificial sequence
  Synthetic oligonucleotide
acgaactaaggtgtac

SEQ ID NO: 844 - DNA, 16 bp, Artificial sequence
  Synthetic oligonucleotide
gctatctttggatcca

SEQ ID NO: 845 - DNA, 16 bp, Artificial sequence
  Synthetic oligonucleotide
aagaacttagttccct

SEQ ID NO: 846 - DNA, 16 bp, Artificial sequence
  Synthetic oligonucleotide
gtaactgccacagtta

SEQ ID NO: 847 - DNA, 16 bp, Artificial sequence
  Synthetic oligonucleotide
gctgaagacggccctt

SEQ ID NO: 848 - DNA, 16 bp, Artificial sequence
  Synthetic oligonucleotide
cattaaggaggttatg

SEQ ID NO: 849 - DNA, 16 bp, Artificial sequence
  Synthetic oligonucleotide
attggtggtgtctcac

SEQ ID NO: 850 - DNA, 16 bp, Artificial sequence
  Synthetic oligonucleotide
gactagaaagatcatc

SEQ ID NO: 851 - DNA, 16 bp, Artificial sequence
  Synthetic oligonucleotide
ccctacactcgaggat

SEQ ID NO: 852 - DNA, 16 bp, Artificial sequence
  Synthetic oligonucleotide
tcaatctatgagaccc

SEQ ID NO: 853 - DNA, 16 bp, Artificial sequence
  Synthetic oligonucleotide
gagcactgcgccctgg

SEQ ID NO: 854 - DNA, 16 bp, Artificial sequence
  Synthetic oligonucleotide
gtacataatgggctaa

SEQ ID NO: 855 - DNA, 16 bp, Artificial sequence
  Synthetic oligonucleotide
tcagttatcctatccc

SEQ ID NO: 856 - DNA, 16 bp, Artificial sequence
  Synthetic oligonucleotide
gtcagttatcctatct

SEQ ID NO: 857 - DNA, 16 bp, Artificial sequence
  Synthetic oligonucleotide
acacatagagctaagg

SEQ ID NO: 858 - DNA, 16 bp, Artificial sequence
  Synthetic oligonucleotide
agcaatagagtaacca

SEQ ID NO: 859 - DNA, 16 bp, Artificial sequence
  Synthetic oligonucleotide
gcatactggtgcccca

SEQ ID NO: 860 - DNA, 16 bp, Artificial sequence
  Synthetic oligonucleotide
ccacaagggcagtacg

SEQ ID NO: 861 - DNA, 16 bp, Artificial sequence
  Synthetic oligonucleotide
ccttaggaaggctccc

SEQ ID NO: 862 - DNA, 16 bp, Artificial sequence
  Synthetic oligonucleotide
gcctatcgccccaagc

SEQ ID NO: 863 - DNA, 16 bp, Artificial sequence
  Synthetic oligonucleotide
tgggtctcttgatttc

SEQ ID NO: 864 - DNA, 16 bp, Artificial sequence
  Synthetic oligonucleotide
cattgccacgatctaa

SEQ ID NO: 865 - DNA, 16 bp, Artificial sequence
  Synthetic oligonucleotide
tgctagatatcgccaa

SEQ ID NO: 866 - DNA, 16 bp, Artificial sequence
  Synthetic oligonucleotide
tcgaatatagaggcct

SEQ ID NO: 867 - DNA, 16 bp, Artificial sequence
  Synthetic oligonucleotide
ggctggatagaatgct

SEQ ID NO: 868 - DNA, 16 bp, Artificial sequence
  Synthetic oligonucleotide
tactatataataccct

SEQ ID NO: 869 - DNA, 16 bp, Artificial sequence
  Synthetic oligonucleotide
ttccgcattgcctaag

SEQ ID NO: 870 - DNA, 16 bp, Artificial sequence
  Synthetic oligonucleotide
attactcaatcatggt

SEQ ID NO: 871 - DNA, 16 bp, Artificial sequence
  Synthetic oligonucleotide
agataatcatcctcag

SEQ ID NO: 872 - DNA, 16 bp, Artificial sequence
  Synthetic oligonucleotide
tcttaacacctgagct

SEQ ID NO: 873 - DNA, 16 bp, Artificial sequence
  Synthetic oligonucleotide
ggctatgcctctctta

SEQ ID NO: 874 - DNA, 16 bp, Artificial sequence
  Synthetic oligonucleotide
tgcttcaacattgttc

SEQ ID NO: 875 - DNA, 16 bp, Artificial sequence
  Synthetic oligonucleotide
tgcgccccggctccac

SEQ ID NO: 876 - DNA, 16 bp, Artificial sequence
  Synthetic oligonucleotide
ggctacgcccggacgc

SEQ ID NO: 877 - DNA, 16 bp, Artificial sequence
  Synthetic oligonucleotide
ggtcgccgcgggtgcc

SEQ ID NO: 878 - DNA, 16 bp, Artificial sequence
  Synthetic oligonucleotide
agaggaatgagctcga

SEQ ID NO: 879 - DNA, 16 bp, Artificial sequence
  Synthetic oligonucleotide
tcgcatctgttgctgc

SEQ ID NO: 880 - DNA, 16 bp, Artificial sequence
  Synthetic oligonucleotide
ggcttcaaggtagtct

SEQ ID NO: 881 - DNA, 16 bp, Artificial sequence
  Synthetic oligonucleotide
tagatccttcacagat

SEQ ID NO: 882 - DNA, 16 bp, Artificial sequence
  Synthetic oligonucleotide
ccggtgcatgtgtctc

SEQ ID NO: 883 - DNA, 16 bp, Artificial sequence
  Synthetic oligonucleotide
aactggcttatggaaa

SEQ ID NO: 884 - DNA, 16 bp, Artificial sequence
  Synthetic oligonucleotide
agaggtcagcaataca

SEQ ID NO: 885 - DNA, 16 bp, Artificial sequence
  Synthetic oligonucleotide
gtgacatgaagcatct

SEQ ID NO: 886 - DNA, 16 bp, Artificial sequence
  Synthetic oligonucleotide
ggtcattatgtgacta

SEQ ID NO: 887 - DNA, 16 bp, Artificial sequence
  Synthetic oligonucleotide
tctatattagagtatg

SEQ ID NO: 888 - DNA, 16 bp, Artificial sequence
  Synthetic oligonucleotide
gataatcgagatttaa

SEQ ID NO: 889 - DNA, 16 bp, Artificial sequence
  Synthetic oligonucleotide
taccacactattataa

SEQ ID NO: 890 - DNA, 16 bp, Artificial sequence
  Synthetic oligonucleotide
ccccaaccagatttaa

SEQ ID NO: 891 - DNA, 16 bp, Artificial sequence
  Synthetic oligonucleotide
ctaccgtatgcccaga

SEQ ID NO: 892 - DNA, 16 bp, Artificial sequence
  Synthetic oligonucleotide
atgaaggtaaaccact

SEQ ID NO: 893 - DNA, 16 bp, Artificial sequence
  Synthetic oligonucleotide
gagcaagtcttgtaag

SEQ ID NO: 894 - DNA, 16 bp, Artificial sequence
  Synthetic oligonucleotide
gggtcaattttcagca

SEQ ID NO: 895 - DNA, 16 bp, Artificial sequence
  Synthetic oligonucleotide
attctatccagggtca

SEQ ID NO: 896 - DNA, 16 bp, Artificial sequence
  Synthetic oligonucleotide
actctagttacatcat

SEQ ID NO: 897 - DNA, 16 bp, Artificial sequence
  Synthetic oligonucleotide
cctgtagacacatact

SEQ ID NO: 898 - DNA, 16 bp, Artificial sequence
  Synthetic oligonucleotide
gcttatattgaagagt

SEQ ID NO: 899 - DNA, 16 bp, Artificial sequence
  Synthetic oligonucleotide
ggtgccactttaattc

SEQ ID NO: 900 - DNA, 16 bp, Artificial sequence
  Synthetic oligonucleotide
ttgagcactgaaagta

SEQ ID NO: 901 - DNA, 16 bp, Artificial sequence
  Synthetic oligonucleotide
tgtaattcatataccc

SEQ ID NO: 902 - DNA, 16 bp, Artificial sequence
  Synthetic oligonucleotide
ggctactggcaaatta

SEQ ID NO: 903 - DNA, 16 bp, Artificial sequence
  Synthetic oligonucleotide
ataatcttaatctgtg

SEQ ID NO: 904 - DNA, 16 bp, Artificial sequence
  Synthetic oligonucleotide
ctctatcaaggtcccc

SEQ ID NO: 905 - DNA, 16 bp, Artificial sequence
  Synthetic oligonucleotide
aggtataactgggcaa

SEQ ID NO: 906 - DNA, 16 bp, Artificial sequence
  Synthetic oligonucleotide
ccacatcaaggctatg

SEQ ID NO: 907 - DNA, 16 bp, Artificial sequence
  Synthetic oligonucleotide
gtagatctaagaagcc

SEQ ID NO: 908 - DNA, 16 bp, Artificial sequence
  Synthetic oligonucleotide
ctcagatgtaccaacg

SEQ ID NO: 909 - DNA, 16 bp, Artificial sequence
  Synthetic oligonucleotide
aggtaacattggtact

SEQ ID NO: 910 - DNA, 16 bp, Artificial sequence
  Synthetic oligonucleotide
tggtcttgttcttatg

SEQ ID NO: 911 - DNA, 16 bp, Artificial sequence
  Synthetic oligonucleotide
aagccttgggtctagc

SEQ ID NO: 912 - DNA, 16 bp, Artificial sequence
  Synthetic oligonucleotide
tgctgggattgatatt

SEQ ID NO: 913 - DNA, 16 bp, Artificial sequence
  Synthetic oligonucleotide
gcggtaactcttcttt

SEQ ID NO: 914 - DNA, 16 bp, Artificial sequence
  Synthetic oligonucleotide
gtttaggcaagcagct

SEQ ID NO: 915 - DNA, 16 bp, Artificial sequence
  Synthetic oligonucleotide
tagataactgtctccc

SEQ ID NO: 916 - DNA, 16 bp, Artificial sequence
  Synthetic oligonucleotide
gcccatagttgacagg

SEQ ID NO: 917 - DNA, 16 bp, Artificial sequence
  Synthetic oligonucleotide
tcaattgagtctgcta

SEQ ID NO: 918 - DNA, 16 bp, Artificial sequence
  Synthetic oligonucleotide
gcaatctgtgatccca

SEQ ID NO: 919 - DNA, 16 bp, Artificial sequence
  Synthetic oligonucleotide
cccactgggtttgtcc

SEQ ID NO: 920 - DNA, 16 bp, Artificial sequence
  Synthetic oligonucleotide
ctgcataccctccagc

SEQ ID NO: 921 - DNA, 16 bp, Artificial sequence
  Synthetic oligonucleotide
ggtcttggtgattggc

SEQ ID NO: 922 - DNA, 16 bp, Artificial sequence
  Synthetic oligonucleotide
tccctatcagctgggc

SEQ ID NO: 923 - DNA, 16 bp, Artificial sequence
  Synthetic oligonucleotide
attaacacctgagctg

SEQ ID NO: 924 - DNA, 16 bp, Artificial sequence
  Synthetic oligonucleotide
agctatggaaagtgtc

SEQ ID NO: 925 - DNA, 16 bp, Artificial sequence
  Synthetic oligonucleotide
tggactcttgatcaca

SEQ ID NO: 926 - DNA, 16 bp, Artificial sequence
  Synthetic oligonucleotide
tcaattctccaccaga

SEQ ID NO: 927 - DNA, 16 bp, Artificial sequence
  Synthetic oligonucleotide
ctaatatagactactc

SEQ ID NO: 928 - DNA, 16 bp, Artificial sequence
  Synthetic oligonucleotide
ggccatcaataaagac

SEQ ID NO: 929 - DNA, 16 bp, Artificial sequence
  Synthetic oligonucleotide
agggaacccttggcta

SEQ ID NO: 930 - DNA, 16 bp, Artificial sequence
  Synthetic oligonucleotide
gtaataggaggtaaga

SEQ ID NO: 931 - DNA, 16 bp, Artificial sequence
  Synthetic oligonucleotide
gtctactagagctgcc

SEQ ID NO: 932 - DNA, 16 bp, Artificial sequence
  Synthetic oligonucleotide
gtcagttatcctatcc

SEQ ID NO: 933 - DNA, 16 bp, Artificial sequence
  Synthetic oligonucleotide
ctctgtcagttatcct

SEQ ID NO: 934 - DNA, 16 bp, Artificial sequence
  Synthetic oligonucleotide
agcaatcttgtggatc

SEQ ID NO: 935 - DNA, 16 bp, Artificial sequence
  Synthetic oligonucleotide
cggcaccaaacaccca

SEQ ID NO: 936 - DNA, 16 bp, Artificial sequence
  Synthetic oligonucleotide
tcccagccgcatggct

SEQ ID NO: 937 - DNA, 16 bp, Artificial sequence
  Synthetic oligonucleotide
tgtaagaggagaccac

SEQ ID NO: 938 - DNA, 16 bp, Artificial sequence
  Synthetic oligonucleotide
taacataagacacgga

SEQ ID NO: 939 - DNA, 16 bp, Artificial sequence
  Synthetic oligonucleotide
agtaatagatctacaa

SEQ ID NO: 940 - DNA, 16 bp, Artificial sequence
  Synthetic oligonucleotide
gtacaggagagattgc

SEQ ID NO: 941 - DNA, 16 bp, Artificial sequence
  Synthetic oligonucleotide
acagagcggtgcaccc

SEQ ID NO: 942 - DNA, 16 bp, Artificial sequence
  Synthetic oligonucleotide
gtctatacgggagatt

SEQ ID NO: 943 - DNA, 16 bp, Artificial sequence
  Synthetic oligonucleotide
tcaactacttttcagc

SEQ ID NO: 944 - DNA, 16 bp, Artificial sequence
  Synthetic oligonucleotide
gcaatccacaattcca

SEQ ID NO: 945 - DNA, 16 bp, Artificial sequence
  Synthetic oligonucleotide
gaaaagacgacacagt

SEQ ID NO: 946 - DNA, 16 bp, Artificial sequence
  Synthetic oligonucleotide
tattccgcattgccta

SEQ ID NO: 947 - DNA, 16 bp, Artificial sequence
  Synthetic oligonucleotide
tcgataatatatggca

SEQ ID NO: 948 - DNA, 16 bp, Artificial sequence
  Synthetic oligonucleotide
caagataatcatcctc

SEQ ID NO: 949 - DNA, 16 bp, Artificial sequence
  Synthetic oligonucleotide
ttatatacgggaaaat

SEQ ID NO: 950 - DNA, 16 bp, Artificial sequence
  Synthetic oligonucleotide
gggcgaggagacaggt

SEQ ID NO: 951 - DNA, 16 bp, Artificial sequence
  Synthetic oligonucleotide
gaccagtaagaagcca

SEQ ID NO: 952 - DNA, 16 bp, Artificial sequence
  Synthetic oligonucleotide
tccaactcccttgacg

SEQ ID NO: 953 - DNA, 16 bp, Artificial sequence
  Synthetic oligonucleotide
agcggcgacggctgcg

SEQ ID NO: 954 - DNA, 16 bp, Artificial sequence
  Synthetic oligonucleotide
ctcccccgacgcgcac

SEQ ID NO: 955 - DNA, 16 bp, Artificial sequence
  Synthetic oligonucleotide
gtgcacgatctgatgc

SEQ ID NO: 956 - DNA, 16 bp, Artificial sequence
  Synthetic oligonucleotide
ctggcagaggtacatc

SEQ ID NO: 957 - DNA, 16 bp, Artificial sequence
  Synthetic oligonucleotide
tatagtaaatttctcc

SEQ ID NO: 958 - DNA, 16 bp, Artificial sequence
  Synthetic oligonucleotide
ctgccgaagcagttct

SEQ ID NO: 959 - DNA, 16 bp, Artificial sequence
  Synthetic oligonucleotide
ccagtgttggtaactg

SEQ ID NO: 960 - DNA, 16 bp, Artificial sequence
  Synthetic oligonucleotide
gatagtatcacctgta

SEQ ID NO: 961 - DNA, 16 bp, Artificial sequence
  Synthetic oligonucleotide
gatttagaattcagtc

SEQ ID NO: 962 - DNA, 16 bp, Artificial sequence
  Synthetic oligonucleotide
gttaaaatgattggtg

SEQ ID NO: 963 - DNA, 16 bp, Artificial sequence
  Synthetic oligonucleotide
ttagagtatgtggcaa

SEQ ID NO: 964 - DNA, 16 bp, Artificial sequence
  Synthetic oligonucleotide
aataaccatcccaagc

SEQ ID NO: 965 - DNA, 16 bp, Artificial sequence
  Synthetic oligonucleotide
ctgccccaaccagatt

SEQ ID NO: 966 - DNA, 16 bp, Artificial sequence
  Synthetic oligonucleotide
ccaatcgagacttaaa

SEQ ID NO: 967 - DNA, 16 bp, Artificial sequence
  Synthetic oligonucleotide
ggagcaagtcttgtaa

SEQ ID NO: 968 - DNA, 16 bp, Artificial sequence
  Synthetic oligonucleotide
ggcttattctagaaac

SEQ ID NO: 969 - DNA, 16 bp, Artificial sequence
  Synthetic oligonucleotide
gacttaattcaagatt

SEQ ID NO: 970 - DNA, 16 bp, Artificial sequence
  Synthetic oligonucleotide
tccccctaagctaaag

SEQ ID NO: 971 - DNA, 16 bp, Artificial sequence
  Synthetic oligonucleotide
gaagatctccatattc

SEQ ID NO: 972 - DNA, 16 bp, Artificial sequence
  Synthetic oligonucleotide
cattaggaacaaggac

SEQ ID NO: 973 - DNA, 16 bp, Artificial sequence
  Synthetic oligonucleotide
ccataagtagatctaa

SEQ ID NO: 974 - DNA, 16 bp, Artificial sequence
  Synthetic oligonucleotide
gaatattgccacccac

SEQ ID NO: 975 - DNA, 16 bp, Artificial sequence
  Synthetic oligonucleotide
gttatgataggcacac

SEQ ID NO: 976 - DNA, 16 bp, Artificial sequence
  Synthetic oligonucleotide
atcccgagtgggctaa

SEQ ID NO: 977 - DNA, 16 bp, Artificial sequence
  Synthetic oligonucleotide
aaaaccctttggtctc

SEQ ID NO: 978 - DNA, 16 bp, Artificial sequence
  Synthetic oligonucleotide
ttctattggaagacca

SEQ ID NO: 979 - DNA, 16 bp, Artificial sequence
  Synthetic oligonucleotide
taatcgaacattgtgt

SEQ ID NO: 980 - DNA, 16 bp, Artificial sequence
  Synthetic oligonucleotide
ttataaagaggctcag

SEQ ID NO: 981 - DNA, 16 bp, Artificial sequence
  Synthetic oligonucleotide
tccgggtaaatatctc

SEQ ID NO: 982 - DNA, 16 bp, Artificial sequence
  Synthetic oligonucleotide
attataaggtcctaca

SEQ ID NO: 983 - DNA, 16 bp, Artificial sequence
  Synthetic oligonucleotide
ctagaatattaaaggg

SEQ ID NO: 984 - DNA, 16 bp, Artificial sequence
  Synthetic oligonucleotide
catcaaaatttcacga

SEQ ID NO: 985 - DNA, 16 bp, Artificial sequence
  Synthetic oligonucleotide
catattaactagatga

SEQ ID NO: 986 - DNA, 16 bp, Artificial sequence
  Synthetic oligonucleotide
atttatcagccattgt

SEQ ID NO: 987 - DNA, 16 bp, Artificial sequence
  Synthetic oligonucleotide
gaataatatgcagaac

SEQ ID NO: 988 - DNA, 16 bp, Artificial sequence
  Synthetic oligonucleotide
attataagctgtgttg

SEQ ID NO: 989 - DNA, 16 bp, Artificial sequence
  Synthetic oligonucleotide
ctcgcaaagcctcttc

SEQ ID NO: 990 - DNA, 16 bp, Artificial sequence
  Synthetic oligonucleotide
aggcaacaacatctaa

SEQ ID NO: 991 - DNA, 16 bp, Artificial sequence
  Synthetic oligonucleotide
gacgggtgaacctgtt

SEQ ID NO: 992 - DNA, 16 bp, Artificial sequence
  Synthetic oligonucleotide
ttattaatcctgtcca

SEQ ID NO: 993 - DNA, 16 bp, Artificial sequence
  Synthetic oligonucleotide
ttacgaaatgtttagt

SEQ ID NO: 994 - DNA, 16 bp, Artificial sequence
  Synthetic oligonucleotide
cagaataagggagatc

SEQ ID NO: 995 - DNA, 16 bp, Artificial sequence
  Synthetic oligonucleotide
ccccaacaactgctaa

SEQ ID NO: 996 - DNA, 16 bp, Artificial sequence
  Synthetic oligonucleotide
gattataacatgctgt

SEQ ID NO: 997 - DNA, 16 bp, Artificial sequence
  Synthetic oligonucleotide
aataattgacctagca

SEQ ID NO: 998 - DNA, 16 bp, Artificial sequence
  Synthetic oligonucleotide
gtaaaaccgatttttc

SEQ ID NO: 999 - DNA, 16 bp, Artificial sequence
  Synthetic oligonucleotide
tcaataaagtgggact

SEQ ID NO: 1000 - DNA, 16 bp, Artificial sequence
  Synthetic oligonucleotide
attattaccccttcta

SEQ ID NO: 1001 - DNA, 16 bp, Artificial sequence
  Synthetic oligonucleotide
gacgcgaaatacttac

SEQ ID NO: 1002 - DNA, 16 bp, Artificial sequence
  Synthetic oligonucleotide
ttcgggttagcagact

SEQ ID NO: 1003 - DNA, 16 bp, Artificial sequence
  Synthetic oligonucleotide
atgtgatatggattct

SEQ ID NO: 1004 - DNA, 16 bp, Artificial sequence
  Synthetic oligonucleotide
gcaatagagtaaccag

SEQ ID NO: 1005 - DNA, 16 bp, Artificial sequence
  Synthetic oligonucleotide
cctaaaataggaatgc

SEQ ID NO: 1006 - DNA, 16 bp, Artificial sequence
  Synthetic oligonucleotide
caattatgacaaacag

SEQ ID NO: 1007 - DNA, 16 bp, Artificial sequence
  Synthetic oligonucleotide
gtataggatctactaa

SEQ ID NO: 1008 - DNA, 16 bp, Artificial sequence
  Synthetic oligonucleotide
cttatattctctccga

SEQ ID NO: 1009 - DNA, 16 bp, Artificial sequence
  Synthetic oligonucleotide
tatttaagccaaaccg

SEQ ID NO: 1010 - DNA, 16 bp, Artificial sequence
  Synthetic oligonucleotide
cctaatatgactcctt

SEQ ID NO: 1011 - DNA, 16 bp, Artificial sequence
  Synthetic oligonucleotide
tataatttccctgatc

SEQ ID NO: 1012 - DNA, 16 bp, Artificial sequence
  Synthetic oligonucleotide
tatgaacaatgtactc

SEQ ID NO: 1013 - DNA, 16 bp, Artificial sequence
  Synthetic oligonucleotide
aataataaacgattct

SEQ ID NO: 1014 - DNA, 16 bp, Artificial sequence
  Synthetic oligonucleotide
tctaaacctaaagact

SEQ ID NO: 1015 - DNA, 16 bp, Artificial sequence
  Synthetic oligonucleotide
ttatactagtacggca

SEQ ID NO: 1016 - DNA, 16 bp, Artificial sequence
  Synthetic oligonucleotide
ctacaacctggacttt

SEQ ID NO: 1017 - DNA, 16 bp, Artificial sequence
  Synthetic oligonucleotide
tataaaccttgctaca

SEQ ID NO: 1018 - DNA, 16 bp, Artificial sequence
  Synthetic oligonucleotide
ttatttaggccccata

SEQ ID NO: 1019 - DNA, 16 bp, Artificial sequence
  Synthetic oligonucleotide
cttatttagcatagtg

SEQ ID NO: 1020 - DNA, 16 bp, Artificial sequence
  Synthetic oligonucleotide
cattaacctcacccat

SEQ ID NO: 1021 - DNA, 16 bp, Artificial sequence
  Synthetic oligonucleotide
gataaccctgaaacaa

SEQ ID NO: 1022 - DNA, 16 bp, Artificial sequence
  Synthetic oligonucleotide
tataagggacttgctg

SEQ ID NO: 1023 - DNA, 16 bp, Artificial sequence
  Synthetic oligonucleotide
accgaaatgatactga

SEQ ID NO: 1024 - DNA, 16 bp, Artificial sequence
  Synthetic oligonucleotide
cttataatgcaatcct

SEQ ID NO: 1025 - DNA, 16 bp, Artificial sequence
  Synthetic oligonucleotide
gtaaatatccattacc

SEQ ID NO: 1026 - DNA, 16 bp, Artificial sequence
  Synthetic oligonucleotide
cataaaccattaagtg

SEQ ID NO: 1027 - DNA, 16 bp, Artificial sequence
  Synthetic oligonucleotide
gaccaacctccccttg

SEQ ID NO: 1028 - DNA, 16 bp, Artificial sequence
  Synthetic oligonucleotide
ctccaactcccttgac

SEQ ID NO: 1029 - DNA, 16 bp, Artificial sequence
  Synthetic oligonucleotide
aagcggcgacggctgc

SEQ ID NO: 1030 - DNA, 16 bp, Artificial sequence
  Synthetic oligonucleotide
cctcccccgacgcgca

SEQ ID NO: 1031 - DNA, 16 bp, Artificial sequence
  Synthetic oligonucleotide
ccggagcctcatgggc

SEQ ID NO: 1032 - DNA, 16 bp, Artificial sequence
  Synthetic oligonucleotide
gatgtctttgccatct

SEQ ID NO: 1033 - DNA, 16 bp, Artificial sequence
  Synthetic oligonucleotide
cttatggtttatatag

SEQ ID NO: 1034 - DNA, 16 bp, Artificial sequence
  Synthetic oligonucleotide
cacctgccgaagcagt

SEQ ID NO: 1035 - DNA, 16 bp, Artificial sequence
  Synthetic oligonucleotide
gagtcccaccatcctg

SEQ ID NO: 1036 - DNA, 16 bp, Artificial sequence
  Synthetic oligonucleotide
tgatagtatcacctgt

SEQ ID NO: 1037 - DNA, 16 bp, Artificial sequence
  Synthetic oligonucleotide
tccggtgcatgtgtct

SEQ ID NO: 1038 - DNA, 16 bp, Artificial sequence
  Synthetic oligonucleotide
aagtctgagtatttag

SEQ ID NO: 1039 - DNA, 16 bp, Artificial sequence
  Synthetic oligonucleotide
aatctatattagagta

SEQ ID NO: 1040 - DNA, 16 bp, Artificial sequence
  Synthetic oligonucleotide
caataaccatcccaag

SEQ ID NO: 1041 - DNA, 16 bp, Artificial sequence
  Synthetic oligonucleotide
gcagactgccccaacc

SEQ ID NO: 1042 - DNA, 16 bp, Artificial sequence
  Synthetic oligonucleotide
aattccaatcgagact

SEQ ID NO: 1043 - DNA, 16 bp, Artificial sequence
  Synthetic oligonucleotide
aggagcaagtcttgta

SEQ ID NO: 1044 - DNA, 16 bp, Artificial sequence
  Synthetic oligonucleotide
ataagggcttattcta

SEQ ID NO: 1045 - DNA, 16 bp, Artificial sequence
  Synthetic oligonucleotide
tccccccagacttaat

SEQ ID NO: 1046 - DNA, 16 bp, Artificial sequence
  Synthetic oligonucleotide
ctccccctaagctaaa

SEQ ID NO: 1047 - DNA, 16 bp, Artificial sequence
  Synthetic oligonucleotide
ggaagatctccatatt

SEQ ID NO: 1048 - DNA, 16 bp, Artificial sequence
  Synthetic oligonucleotide
tacattaggaacaagg

SEQ ID NO: 1049 - DNA, 16 bp, Artificial sequence
  Synthetic oligonucleotide
accataagtagatcta

SEQ ID NO: 1050 - DNA, 16 bp, Artificial sequence
  Synthetic oligonucleotide
ctgaatattgccaccc

SEQ ID NO: 1051 - DNA, 16 bp, Artificial sequence
  Synthetic oligonucleotide
tgttatgataggcaca

SEQ ID NO: 1052 - DNA, 16 bp, Artificial sequence
  Synthetic oligonucleotide
catcccgagtgggcta

SEQ ID NO: 1053 - DNA, 16 bp, Artificial sequence
  Synthetic oligonucleotide
caaaaccctttggtct

SEQ ID NO: 1054 - DNA, 16 bp, Artificial sequence
  Synthetic oligonucleotide
cttgttctattggaag

SEQ ID NO: 1055 - DNA, 16 bp, Artificial sequence
  Synthetic oligonucleotide
ataatcgaacattgtg

SEQ ID NO: 1056 - DNA, 16 bp, Artificial sequence
  Synthetic oligonucleotide
gattataaagaggctc

SEQ ID NO: 1057 - DNA, 16 bp, Artificial sequence
  Synthetic oligonucleotide
cataaaagttccccag

SEQ ID NO: 1058 - DNA, 16 bp, Artificial sequence
  Synthetic oligonucleotide
aattataaggtcctac

SEQ ID NO: 1059 - DNA, 16 bp, Artificial sequence
  Synthetic oligonucleotide
gattaaatactgacca

SEQ ID NO: 1060 - DNA, 16 bp, Artificial sequence
  Synthetic oligonucleotide
aaaacggagtaatgcc

SEQ ID NO: 1061 - DNA, 16 bp, Artificial sequence
  Synthetic oligonucleotide
ctttaaagccctaatt

SEQ ID NO: 1062 - DNA, 16 bp, Artificial sequence
  Synthetic oligonucleotide
gtaatttatcagccat

SEQ ID NO: 1063 - DNA, 16 bp, Artificial sequence
  Synthetic oligonucleotide
tctgaataatatgcag

SEQ ID NO: 1064 - DNA, 16 bp, Artificial sequence
  Synthetic oligonucleotide
gttaattataagctgt

SEQ ID NO: 1065 - DNA, 16 bp, Artificial sequence
  Synthetic oligonucleotide
agggaaaactttgcac

SEQ ID NO: 1066 - DNA, 16 bp, Artificial sequence
  Synthetic oligonucleotide
tcttaagggaatgtat

SEQ ID NO: 1067 - DNA, 16 bp, Artificial sequence
  Synthetic oligonucleotide
cttaacctatgccaaa

SEQ ID NO: 1068 - DNA, 16 bp, Artificial sequence
  Synthetic oligonucleotide
attattaatcctgtcc

SEQ ID NO: 1069 - DNA, 16 bp, Artificial sequence
  Synthetic oligonucleotide
agtaatatgtacatgg

SEQ ID NO: 1070 - DNA, 16 bp, Artificial sequence
  Synthetic oligonucleotide
gagcaacaactatgag

SEQ ID NO: 1071 - DNA, 16 bp, Artificial sequence
  Synthetic oligonucleotide
aaatcgaggcgaatct

SEQ ID NO: 1072 - DNA, 16 bp, Artificial sequence
  Synthetic oligonucleotide
tgattataacatgctg

SEQ ID NO: 1073 - DNA, 16 bp, Artificial sequence
  Synthetic oligonucleotide
aaataattgacctagc

SEQ ID NO: 1074 - DNA, 16 bp, Artificial sequence
  Synthetic oligonucleotide
taagaacgacatatgc

SEQ ID NO: 1075 - DNA, 16 bp, Artificial sequence
  Synthetic oligonucleotide
cttcaataaagtggga

SEQ ID NO: 1076 - DNA, 16 bp, Artificial sequence
  Synthetic oligonucleotide
taattattaccccttc

SEQ ID NO: 1077 - DNA, 16 bp, Artificial sequence
  Synthetic oligonucleotide
aatcaaccttgttaga

SEQ ID NO: 1078 - DNA, 16 bp, Artificial sequence
  Synthetic oligonucleotide
cttcaaaagcacggtg

SEQ ID NO: 1079 - DNA, 16 bp, Artificial sequence
  Synthetic oligonucleotide
tatgtgatatggattc

SEQ ID NO: 1080 - DNA, 16 bp, Artificial sequence
  Synthetic oligonucleotide
tagcaatagagtaacc

SEQ ID NO: 1081 - DNA, 16 bp, Artificial sequence
  Synthetic oligonucleotide
atttaggtactcagta

SEQ ID NO: 1082 - DNA, 16 bp, Artificial sequence
  Synthetic oligonucleotide
cttgaatactacacca

SEQ ID NO: 1083 - DNA, 16 bp, Artificial sequence
  Synthetic oligonucleotide
cctgaacacaggagta

SEQ ID NO: 1084 - DNA, 16 bp, Artificial sequence
  Synthetic oligonucleotide
acttatattctctccg

SEQ ID NO: 1085 - DNA, 16 bp, Artificial sequence
  Synthetic oligonucleotide
gtatttaagccaaacc

SEQ ID NO: 1086 - DNA, 16 bp, Artificial sequence
  Synthetic oligonucleotide
actcaaggaaccattt

SEQ ID NO: 1087 - DNA, 16 bp, Artificial sequence
  Synthetic oligonucleotide
cattagtaggtatttc

SEQ ID NO: 1088 - DNA, 16 bp, Artificial sequence
  Synthetic oligonucleotide
ctttagtaacacgaat

SEQ ID NO: 1089 - DNA, 16 bp, Artificial sequence
  Synthetic oligonucleotide
caataataaacgattc

SEQ ID NO: 1090 - DNA, 16 bp, Artificial sequence
  Synthetic oligonucleotide
cataaaccttagtcct

SEQ ID NO: 1091 - DNA, 16 bp, Artificial sequence
  Synthetic oligonucleotide
tcttatactagtacgg

SEQ ID NO: 1092 - DNA, 16 bp, Artificial sequence
  Synthetic oligonucleotide
ttaatacacaggttcc

SEQ ID NO: 1093 - DNA, 16 bp, Artificial sequence
  Synthetic oligonucleotide
atataaaccttgctac

SEQ ID NO: 1094 - DNA, 16 bp, Artificial sequence
  Synthetic oligonucleotide
ctaagaaactcatagt

SEQ ID NO: 1095 - DNA, 16 bp, Artificial sequence
  Synthetic oligonucleotide
aacggacaacttaaca

SEQ ID NO: 1096 - DNA, 16 bp, Artificial sequence
  Synthetic oligonucleotide
caatatcacttgggcc

SEQ ID NO: 1097 - DNA, 16 bp, Artificial sequence
  Synthetic oligonucleotide
attaaacattcggatt

SEQ ID NO: 1098 - DNA, 16 bp, Artificial sequence
  Synthetic oligonucleotide
atataagggacttgct

SEQ ID NO: 1099 - DNA, 16 bp, Artificial sequence
  Synthetic oligonucleotide
ctttacaccgaaatga

SEQ ID NO: 1100 - DNA, 16 bp, Artificial sequence
  Synthetic oligonucleotide
ccttataatgcaatcc

SEQ ID NO: 1101 - DNA, 16 bp, Artificial sequence
  Synthetic oligonucleotide
ctaagtaaggtttccc

SEQ ID NO: 1102 - DNA, 16 bp, Artificial sequence
  Synthetic oligonucleotide
cattaacactcctcag

SEQ ID NO: 1103 - DNA, 16 bp, Artificial sequence
  Synthetic oligonucleotide
aaccaaccttccctac

SEQ ID NO: 1104 - DNA, 16 bp, Artificial sequence
  Synthetic oligonucleotide
gaactttttccctcca

SEQ ID NO: 1105 - DNA, 16 bp, Artificial sequence
  Synthetic oligonucleotide
gaagcggcgacggctg

SEQ ID NO: 1106 - DNA, 16 bp, Artificial sequence
  Synthetic oligonucleotide
gcctcccccgacgcgc

SEQ ID NO: 1107 - DNA, 16 bp, Artificial sequence
  Synthetic oligonucleotide
tccggagcctcatggg

SEQ ID NO: 1108 - DNA, 16 bp, Artificial sequence
  Synthetic oligonucleotide
agaagatgtctttgcc

SEQ ID NO: 1109 - DNA, 16 bp, Artificial sequence
  Synthetic oligonucleotide
gttcttatggtttata

SEQ ID NO: 1110 - DNA, 16 bp, Artificial sequence
  Synthetic oligonucleotide
cctcacctgccgaagc

SEQ ID NO: 1111 - DNA, 16 bp, Artificial sequence
  Synthetic oligonucleotide
ggattttgagtcccac

SEQ ID NO: 1112 - DNA, 16 bp, Artificial sequence
  Synthetic oligonucleotide
ttgatagtatcacctg

SEQ ID NO: 1113 - DNA, 16 bp, Artificial sequence
  Synthetic oligonucleotide
ttatggaaatttccgg

SEQ ID NO: 1114 - DNA, 16 bp, Artificial sequence
  Synthetic oligonucleotide
acttctaagtctgagt

SEQ ID NO: 1115 - DNA, 16 bp, Artificial sequence
  Synthetic oligonucleotide
accgaccctgccaaaa

SEQ ID NO: 1116 - DNA, 16 bp, Artificial sequence
  Synthetic oligonucleotide
acaataaccatcccaa

SEQ ID NO: 1117 - DNA, 16 bp, Artificial sequence
  Synthetic oligonucleotide
ctaaactacttcaaac

SEQ ID NO: 1118 - DNA, 16 bp, Artificial sequence
  Synthetic oligonucleotide
gaattccaatcgagac

SEQ ID NO: 1119 - DNA, 16 bp, Artificial sequence
  Synthetic oligonucleotide
taggagcaagtcttgt

SEQ ID NO: 1120 - DNA, 16 bp, Artificial sequence
  Synthetic oligonucleotide
ctgttatgaacccttg

SEQ ID NO: 1121 - DNA, 16 bp, Artificial sequence
  Synthetic oligonucleotide
ggccatttccccccag

SEQ ID NO: 1122 - DNA, 16 bp, Artificial sequence
  Synthetic oligonucleotide
cctccccctaagctaa

SEQ ID NO: 1123 - DNA, 16 bp, Artificial sequence
  Synthetic oligonucleotide
aggaagatctccatat

SEQ ID NO: 1124 - DNA, 16 bp, Artificial sequence
  Synthetic oligonucleotide
cttttacattaggaac

SEQ ID NO: 1125 - DNA, 16 bp, Artificial sequence
  Synthetic oligonucleotide
aaccataagtagatct

SEQ ID NO: 1126 - DNA, 16 bp, Artificial sequence
  Synthetic oligonucleotide
actgaatattgccacc

SEQ ID NO: 1127 - DNA, 16 bp, Artificial sequence
  Synthetic oligonucleotide
ttgttatgataggcac

SEQ ID NO: 1128 - DNA, 16 bp, Artificial sequence
  Synthetic oligonucleotide
ttacatcccgagtggg

SEQ ID NO: 1129 - DNA, 16 bp, Artificial sequence
  Synthetic oligonucleotide
ccaaaaccctttggtc

SEQ ID NO: 1130 - DNA, 16 bp, Artificial sequence
  Synthetic oligonucleotide
ttgccagttcttgttc

SEQ ID NO: 1131 - DNA, 16 bp, Artificial sequence
  Synthetic oligonucleotide
aataatcgaacattgt

SEQ ID NO: 1132 - DNA, 16 bp, Artificial sequence
  Synthetic oligonucleotide
ttaaaaggtttggcac

SEQ ID NO: 1133 - DNA, 16 bp, Artificial sequence
  Synthetic oligonucleotide
tatagtaagactaatc

SEQ ID NO: 1134 - DNA, 16 bp, Artificial sequence
  Synthetic oligonucleotide
caaattataaggtcct

SEQ ID NO: 1135 - DNA, 16 bp, Artificial sequence
  Synthetic oligonucleotide
aataatagatactgcc

SEQ ID NO: 1136 - DNA, 16 bp, Artificial sequence
  Synthetic oligonucleotide
actaaaatccccaagg

SEQ ID NO: 1137 - DNA, 16 bp, Artificial sequence
  Synthetic oligonucleotide
aattatataaggctgt

SEQ ID NO: 1138 - DNA, 16 bp, Artificial sequence
  Synthetic oligonucleotide
gtaaatactctagttc

SEQ ID NO: 1139 - DNA, 16 bp, Artificial sequence
  Synthetic oligonucleotide
tattaggacaaagtac

SEQ ID NO: 1140 - DNA, 16 bp, Artificial sequence
  Synthetic oligonucleotide
atctcggaaatttaaa

SEQ ID NO: 1141 - DNA, 16 bp, Artificial sequence
  Synthetic oligonucleotide
gagggaaaactttgca

SEQ ID NO: 1142 - DNA, 16 bp, Artificial sequence
  Synthetic oligonucleotide
caggaaaaatctaggt

SEQ ID NO: 1143 - DNA, 16 bp, Artificial sequence
  Synthetic oligonucleotide
tcttaacctatgccaa

SEQ ID NO: 1144 - DNA, 16 bp, Artificial sequence
  Synthetic oligonucleotide
gtattattaatcctgt

SEQ ID NO: 1145 - DNA, 16 bp, Artificial sequence
  Synthetic oligonucleotide
ccacaatatactccaa

SEQ ID NO: 1146 - DNA, 16 bp, Artificial sequence
  Synthetic oligonucleotide
catatacgcaattagt

SEQ ID NO: 1147 - DNA, 16 bp, Artificial sequence
  Synthetic oligonucleotide
caaatcgaggcgaatc

SEQ ID NO: 1148 - DNA, 16 bp, Artificial sequence
  Synthetic oligonucleotide
ttgcaatagtcaccca

SEQ ID NO: 1149 - DNA, 16 bp, Artificial sequence
  Synthetic oligonucleotide
tattagcacctgggta

SEQ ID NO: 1150 - DNA, 16 bp, Artificial sequence
  Synthetic oligonucleotide
ttttaagaacgacata

SEQ ID NO: 1151 - DNA, 16 bp, Artificial sequence
  Synthetic oligonucleotide
atattacaatcccagc

SEQ ID NO: 1152 - DNA, 16 bp, Artificial sequence
  Synthetic oligonucleotide
gataattattacccct

SEQ ID NO: 1153 - DNA, 16 bp, Artificial sequence
  Synthetic oligonucleotide
aattacaatcaacctt

SEQ ID NO: 1154 - DNA, 16 bp, Artificial sequence
  Synthetic oligonucleotide
gattaacccagtagag

SEQ ID NO: 1155 - DNA, 16 bp, Artificial sequence
  Synthetic oligonucleotide
catttataccaggcac

SEQ ID NO: 1156 - DNA, 16 bp, Artificial sequence
  Synthetic oligonucleotide
gtagcaatagagtaac

SEQ ID NO: 1157 - DNA, 16 bp, Artificial sequence
  Synthetic oligonucleotide
gtatttaggtactcag

SEQ ID NO: 1158 - DNA, 16 bp, Artificial sequence
  Synthetic oligonucleotide
cttaacaaccctacga

SEQ ID NO: 1159 - DNA, 16 bp, Artificial sequence
  Synthetic oligonucleotide
cctcaatacagatgaa

SEQ ID NO: 1160 - DNA, 16 bp, Artificial sequence
  Synthetic oligonucleotide
gaatatatgggtttca

SEQ ID NO: 1161 - DNA, 16 bp, Artificial sequence
  Synthetic oligonucleotide
gcttaaaaggacagta

SEQ ID NO: 1162 - DNA, 16 bp, Artificial sequence
  Synthetic oligonucleotide
atttaatggcttgcat

SEQ ID NO: 1163 - DNA, 16 bp, Artificial sequence
  Synthetic oligonucleotide
aattagaaacttggcc

SEQ ID NO: 1164 - DNA, 16 bp, Artificial sequence
  Synthetic oligonucleotide
catataagatgtttgc

SEQ ID NO: 1165 - DNA, 16 bp, Artificial sequence
  Synthetic oligonucleotide
ttacaataataaacga

SEQ ID NO: 1166 - DNA, 16 bp, Artificial sequence
  Synthetic oligonucleotide
ctggaatagtgggtgc

SEQ ID NO: 1167 - DNA, 16 bp, Artificial sequence
  Synthetic oligonucleotide
atttacttggcaactc

SEQ ID NO: 1168 - DNA, 16 bp, Artificial sequence
  Synthetic oligonucleotide
tttaatacacaggttc

SEQ ID NO: 1169 - DNA, 16 bp, Artificial sequence
  Synthetic oligonucleotide
catataaaccttgcta

SEQ ID NO: 1170 - DNA, 16 bp, Artificial sequence
  Synthetic oligonucleotide
ctttaggtgcctcctt

SEQ ID NO: 1171 - DNA, 16 bp, Artificial sequence
  Synthetic oligonucleotide
ctccaacggacaactt

SEQ ID NO: 1172 - DNA, 16 bp, Artificial sequence
  Synthetic oligonucleotide
atttacaagtgagcac

SEQ ID NO: 1173 - DNA, 16 bp, Artificial sequence
  Synthetic oligonucleotide
gattaaacattcggat

SEQ ID NO: 1174 - DNA, 16 bp, Artificial sequence
  Synthetic oligonucleotide
agttataacagtgtaa

SEQ ID NO: 1175 - DNA, 16 bp, Artificial sequence
  Synthetic oligonucleotide
tataataacccattgt

SEQ ID NO: 1176 - DNA, 16 bp, Artificial sequence
  Synthetic oligonucleotide
cttgaatagctatgtg

SEQ ID NO: 1177 - DNA, 16 bp, Artificial sequence
  Synthetic oligonucleotide
ctttagactaagtaag

SEQ ID NO: 1178 - DNA, 16 bp, Artificial sequence
  Synthetic oligonucleotide
ccttaggagatgcacc

SEQ ID NO: 1179 - DNA, 16 bp, Artificial sequence
  Synthetic oligonucleotide
ccccaacctgaggagc

SEQ ID NO: 1180 - DNA, 16 bp, Artificial sequence
  Synthetic oligonucleotide
agaactttttccctcc

SEQ ID NO: 1181 - DNA, 16 bp, Artificial sequence
  Synthetic oligonucleotide
agaagcggcgacggct

SEQ ID NO: 1182 - DNA, 16 bp, Artificial sequence
  Synthetic oligonucleotide
cgggatccatggcttc

SEQ ID NO: 1183 - DNA, 16 bp, Artificial sequence
  Synthetic oligonucleotide
cttccggagcctcatg

SEQ ID NO: 1184 - DNA, 16 bp, Artificial sequence
  Synthetic oligonucleotide
tctgaccagaagatgt

SEQ ID NO: 1185 - DNA, 16 bp, Artificial sequence
  Synthetic oligonucleotide
caagaggtggtcttgt

SEQ ID NO: 1186 - DNA, 16 bp, Artificial sequence
  Synthetic oligonucleotide
gtggcctcacctgccg

SEQ ID NO: 1187 - DNA, 16 bp, Artificial sequence
  Synthetic oligonucleotide
actggattttgagtcc

SEQ ID NO: 1188 - DNA, 16 bp, Artificial sequence
  Synthetic oligonucleotide
gttgatagtatcacct

SEQ ID NO: 1189 - DNA, 16 bp, Artificial sequence
  Synthetic oligonucleotide
gcttatggaaatttcc

SEQ ID NO: 1190 - DNA, 16 bp, Artificial sequence
  Synthetic oligonucleotide
gacttctaagtctgag

SEQ ID NO: 1191 - DNA, 16 bp, Artificial sequence
  Synthetic oligonucleotide
caccgaccctgccaaa

SEQ ID NO: 1192 - DNA, 16 bp, Artificial sequence
  Synthetic oligonucleotide
tacaataaccatccca

SEQ ID NO: 1193 - DNA, 16 bp, Artificial sequence
  Synthetic oligonucleotide
cactaaactacttcaa

SEQ ID NO: 1194 - DNA, 16 bp, Artificial sequence
  Synthetic oligonucleotide
tgaattccaatcgaga

SEQ ID NO: 1195 - DNA, 16 bp, Artificial sequence
  Synthetic oligonucleotide
tagaagtaggagcaag

SEQ ID NO: 1196 - DNA, 16 bp, Artificial sequence
  Synthetic oligonucleotide
cctgttatgaaccctt

SEQ ID NO: 1197 - DNA, 16 bp, Artificial sequence
  Synthetic oligonucleotide
ctaaaactccatctgc

SEQ ID NO: 1198 - DNA, 16 bp, Artificial sequence
  Synthetic oligonucleotide
ccctccccctaagcta

SEQ ID NO: 1199 - DNA, 16 bp, Artificial sequence
  Synthetic oligonucleotide
ggtaaaggaagatctc

SEQ ID NO: 1200 - DNA, 16 bp, Artificial sequence
  Synthetic oligonucleotide
cacttttacattagga

SEQ ID NO: 1201 - DNA, 16 bp, Artificial sequence
  Synthetic oligonucleotide
caaccataagtagatc

SEQ ID NO: 1202 - DNA, 16 bp, Artificial sequence
  Synthetic oligonucleotide
aagcactgaatattgc

SEQ ID NO: 1203 - DNA, 16 bp, Artificial sequence
  Synthetic oligonucleotide
attgttatgataggca

SEQ ID NO: 1204 - DNA, 16 bp, Artificial sequence
  Synthetic oligonucleotide
agttacatcccgagtg

SEQ ID NO: 1205 - DNA, 16 bp, Artificial sequence
  Synthetic oligonucleotide
tccaaaaccctttggt

SEQ ID NO: 1206 - DNA, 16 bp, Artificial sequence
  Synthetic oligonucleotide
attgccagttcttgtt

SEQ ID NO: 1207 - DNA, 16 bp, Artificial sequence
  Synthetic oligonucleotide
gcacaataatcgaaca

SEQ ID NO: 1208 - DNA, 16 bp, Artificial sequence
  Synthetic oligonucleotide
ccccaaaagccctact

SEQ ID NO: 1209 - DNA, 16 bp, Artificial sequence
  Synthetic oligonucleotide
aattttataagcccac

SEQ ID NO: 1210 - DNA, 16 bp, Artificial sequence
  Synthetic oligonucleotide
taaaaacattgtggcc

SEQ ID NO: 1211 - DNA, 16 bp, Artificial sequence
  Synthetic oligonucleotide
cccaaataatagatac

SEQ ID NO: 1212 - DNA, 16 bp, Artificial sequence
  Synthetic oligonucleotide
ccccaatataaagaac

SEQ ID NO: 1213 - DNA, 16 bp, Artificial sequence
  Synthetic oligonucleotide
taattatataaggctg

SEQ ID NO: 1214 - DNA, 16 bp, Artificial sequence
  Synthetic oligonucleotide
agtaaatactctagtt

SEQ ID NO: 1215 - DNA, 16 bp, Artificial sequence
  Synthetic oligonucleotide
ctatttagaataagtg

SEQ ID NO: 1216 - DNA, 16 bp, Artificial sequence
  Synthetic oligonucleotide
gataaccaatgcacca

SEQ ID NO: 1217 - DNA, 16 bp, Artificial sequence
  Synthetic oligonucleotide
gataaacactgcagag

SEQ ID NO: 1218 - DNA, 16 bp, Artificial sequence
  Synthetic oligonucleotide
acacaatatcaagtcc

SEQ ID NO: 1219 - DNA, 16 bp, Artificial sequence
  Synthetic oligonucleotide
atgaataagtatgcca

SEQ ID NO: 1220 - DNA, 16 bp, Artificial sequence
  Synthetic oligonucleotide
tataaggcatcttgga

SEQ ID NO: 1221 - DNA, 16 bp, Artificial sequence
  Synthetic oligonucleotide
aaccaaggatagtcat

SEQ ID NO: 1222 - DNA, 16 bp, Artificial sequence
  Synthetic oligonucleotide
gacggaagttgcaagg

SEQ ID NO: 1223 - DNA, 16 bp, Artificial sequence
  Synthetic oligonucleotide
aattaagggcccacaa

SEQ ID NO: 1224 - DNA, 16 bp, Artificial sequence
  Synthetic oligonucleotide
gccaaaaattcttgca

SEQ ID NO: 1225 - DNA, 16 bp, Artificial sequence
  Synthetic oligonucleotide
cttattagcacctggg

SEQ ID NO: 1226 - DNA, 16 bp, Artificial sequence
  Synthetic oligonucleotide
cttagatactactttg

SEQ ID NO: 1227 - DNA, 16 bp, Artificial sequence
  Synthetic oligonucleotide
tatattacaatcccag

SEQ ID NO: 1228 - DNA, 16 bp, Artificial sequence
  Synthetic oligonucleotide
ctgaaaaagttatgcc

SEQ ID NO: 1229 - DNA, 16 bp, Artificial sequence
  Synthetic oligonucleotide
gaattacaatcaacct

SEQ ID NO: 1230 - DNA, 16 bp, Artificial sequence
  Synthetic oligonucleotide
atttagcatgattaac

SEQ ID NO: 1231 - DNA, 16 bp, Artificial sequence
  Synthetic oligonucleotide
gtattacaaactgatt

SEQ ID NO: 1232 - DNA, 16 bp, Artificial sequence
  Synthetic oligonucleotide
attgtagcaatagagt

SEQ ID NO: 1233 - DNA, 16 bp, Artificial sequence
  Synthetic oligonucleotide
catgaaatgatggaac

SEQ ID NO: 1234 - DNA, 16 bp, Artificial sequence
  Synthetic oligonucleotide
acttaacaaccctacg

SEQ ID NO: 1235 - DNA, 16 bp, Artificial sequence
  Synthetic oligonucleotide
aattactactggccat

SEQ ID NO: 1236 - DNA, 16 bp, Artificial sequence
  Synthetic oligonucleotide
cttgaatatatgggtt

SEQ ID NO: 1237 - DNA, 16 bp, Artificial sequence
  Synthetic oligonucleotide
tattaacatacctcat

SEQ ID NO: 1238 - DNA, 16 bp, Artificial sequence
  Synthetic oligonucleotide
aatttaatggcttgca

SEQ ID NO: 1239 - DNA, 16 bp, Artificial sequence
  Synthetic oligonucleotide
gtaattagaaacttgg

SEQ ID NO: 1240 - DNA, 16 bp, Artificial sequence
  Synthetic oligonucleotide
gcatataagatgtttg

SEQ ID NO: 1241 - DNA, 16 bp, Artificial sequence
  Synthetic oligonucleotide
cctcaaaacttggatt

SEQ ID NO: 1242 - DNA, 16 bp, Artificial sequence
  Synthetic oligonucleotide
tattatgaggactgat

SEQ ID NO: 1243 - DNA, 16 bp, Artificial sequence
  Synthetic oligonucleotide
gatataagttaccaat

SEQ ID NO: 1244 - DNA, 16 bp, Artificial sequence
  Synthetic oligonucleotide
aataacatggttctgt

SEQ ID NO: 1245 - DNA, 16 bp, Artificial sequence
  Synthetic oligonucleotide
acttataaggccagca

SEQ ID NO: 1246 - DNA, 16 bp, Artificial sequence
  Synthetic oligonucleotide
atttaactcctgaagt

SEQ ID NO: 1247 - DNA, 16 bp, Artificial sequence
  Synthetic oligonucleotide
gattaatggtggcatt

SEQ ID NO: 1248 - DNA, 16 bp, Artificial sequence
  Synthetic oligonucleotide
caatttacaagtgagc

SEQ ID NO: 1249 - DNA, 16 bp, Artificial sequence
  Synthetic oligonucleotide
ctacaaaagagctatg

SEQ ID NO: 1250 - DNA, 16 bp, Artificial sequence
  Synthetic oligonucleotide
tgacaacacagttata

SEQ ID NO: 1251 - DNA, 16 bp, Artificial sequence
  Synthetic oligonucleotide
atataataacccattg

SEQ ID NO: 1252 - DNA, 16 bp, Artificial sequence
  Synthetic oligonucleotide
ccttaagaacatgagg

SEQ ID NO: 1253 - DNA, 16 bp, Artificial sequence
  Synthetic oligonucleotide
acgggaaatcatatag

SEQ ID NO: 1254 - DNA, 16 bp, Artificial sequence
  Synthetic oligonucleotide
ctgcaagaatacttta

SEQ ID NO: 1255 - DNA, 16 bp, Artificial sequence
  Synthetic oligonucleotide
gaccaacctccctcag

SEQ ID NO: 1256 - DNA, 16 bp, Artificial sequence
  Synthetic oligonucleotide
gagaactttttccctc

SEQ ID NO: 1257 - DNA, 16 bp, Artificial sequence
  Synthetic oligonucleotide
gtggagaagcggcgac

SEQ ID NO: 1258 - DNA, 16 bp, Artificial sequence
  Synthetic oligonucleotide
ccgggatccatggctt

SEQ ID NO: 1259 - DNA, 16 bp, Artificial sequence
  Synthetic oligonucleotide
gcttccggagcctcat

SEQ ID NO: 1260 - DNA, 16 bp, Artificial sequence
  Synthetic oligonucleotide
ctctgaccagaagatg

SEQ ID NO: 1261 - DNA, 16 bp, Artificial sequence
  Synthetic oligonucleotide
ccaagaggtggtcttg

SEQ ID NO: 1262 - DNA, 16 bp, Artificial sequence
  Synthetic oligonucleotide
gcattgcctgtggcct

SEQ ID NO: 1263 - DNA, 16 bp, Artificial sequence
  Synthetic oligonucleotide
tcccgggagaagacac

SEQ ID NO: 1264 - DNA, 16 bp, Artificial sequence
  Synthetic oligonucleotide
ctttggttgatagtat

SEQ ID NO: 1265 - DNA, 16 bp, Artificial sequence
  Synthetic oligonucleotide
ggcttatggaaatttc

SEQ ID NO: 1266 - DNA, 16 bp, Artificial sequence
  Synthetic oligonucleotide
catgaagcatctgact

SEQ ID NO: 1267 - DNA, 16 bp, Artificial sequence
  Synthetic oligonucleotide
ccaccgaccctgccaa

SEQ ID NO: 1268 - DNA, 16 bp, Artificial sequence
  Synthetic oligonucleotide
ctacaataaccatccc

SEQ ID NO: 1269 - DNA, 16 bp, Artificial sequence
  Synthetic oligonucleotide
gaacactaaactactt

SEQ ID NO: 1270 - DNA, 16 bp, Artificial sequence
  Synthetic oligonucleotide
ctgaattccaatcgag

SEQ ID NO: 1271 - DNA, 16 bp, Artificial sequence
  Synthetic oligonucleotide
ttctatccagggtcaa

SEQ ID NO: 1272 - DNA, 16 bp, Artificial sequence
  Synthetic oligonucleotide
gcctgttatgaaccct

SEQ ID NO: 1273 - DNA, 16 bp, Artificial sequence
  Synthetic oligonucleotide
aatttcattactactc

SEQ ID NO: 1274 - DNA, 16 bp, Artificial sequence
  Synthetic oligonucleotide
cccccccaaactttcc

SEQ ID NO: 1275 - DNA, 16 bp, Artificial sequence
  Synthetic oligonucleotide
gggtaaaggaagatct

SEQ ID NO: 1276 - DNA, 16 bp, Artificial sequence
  Synthetic oligonucleotide
gcacttttacattagg

SEQ ID NO: 1277 - DNA, 16 bp, Artificial sequence
  Synthetic oligonucleotide
tcaaccataagtagat

SEQ ID NO: 1278 - DNA, 16 bp, Artificial sequence
  Synthetic oligonucleotide
aagtgttaagcactga

SEQ ID NO: 1279 - DNA, 16 bp, Artificial sequence
  Synthetic oligonucleotide
aattgttatgataggc

SEQ ID NO: 1280 - DNA, 16 bp, Artificial sequence
  Synthetic oligonucleotide
aagttacatcccgagt

SEQ ID NO: 1281 - DNA, 16 bp, Artificial sequence
  Synthetic oligonucleotide
gagttccaaaaccctt

SEQ ID NO: 1282 - DNA, 16 bp, Artificial sequence
  Synthetic oligonucleotide
tattgccagttcttgt

SEQ ID NO: 1283 - DNA, 16 bp, Artificial sequence
  Synthetic oligonucleotide
ctattggaatgttaac

SEQ ID NO: 1284 - DNA, 16 bp, Artificial sequence
  Synthetic oligonucleotide
aattagactcccccaa

SEQ ID NO: 1285 - DNA, 16 bp, Artificial sequence
  Synthetic oligonucleotide
cataacatcatggaag

SEQ ID NO: 1286 - DNA, 16 bp, Artificial sequence
  Synthetic oligonucleotide
ctaaaaacattgtggc

SEQ ID NO: 1287 - DNA, 16 bp, Artificial sequence
  Synthetic oligonucleotide
ctttaggttaagcaat

SEQ ID NO: 1288 - DNA, 16 bp, Artificial sequence
  Synthetic oligonucleotide
ctttacatgaactgat

SEQ ID NO: 1289 - DNA, 16 bp, Artificial sequence
  Synthetic oligonucleotide
gttaaacacatctcag

SEQ ID NO: 1290 - DNA, 16 bp, Artificial sequence
  Synthetic oligonucleotide
tataataccacaaagt

SEQ ID NO: 1291 - DNA, 16 bp, Artificial sequence
  Synthetic oligonucleotide
tattaacctggagagt

SEQ ID NO: 1292 - DNA, 16 bp, Artificial sequence
  Synthetic oligonucleotide
cgtgaaaagaaaggcc

SEQ ID NO: 1293 - DNA, 16 bp, Artificial sequence
  Synthetic oligonucleotide
agcgggtttagaatgc

SEQ ID NO: 1294 - DNA, 16 bp, Artificial sequence
  Synthetic oligonucleotide
cgaaaatagttctcaa

SEQ ID NO: 1295 - DNA, 16 bp, Artificial sequence
  Synthetic oligonucleotide
attatcgcacatacat

SEQ ID NO: 1296 - DNA, 16 bp, Artificial sequence
  Synthetic oligonucleotide
tatataaggcatcttg

SEQ ID NO: 1297 - DNA, 16 bp, Artificial sequence
  Synthetic oligonucleotide
aataaccaaggatagt

SEQ ID NO: 1298 - DNA, 16 bp, Artificial sequence
  Synthetic oligonucleotide
gctaaaatgatacttc

SEQ ID NO: 1299 - DNA, 16 bp, Artificial sequence
  Synthetic oligonucleotide
taattaagggcccaca

SEQ ID NO: 1300 - DNA, 16 bp, Artificial sequence
  Synthetic oligonucleotide
tggcaaaagagtggtg

SEQ ID NO: 1301 - DNA, 16 bp, Artificial sequence
  Synthetic oligonucleotide
acttattagcacctgg

SEQ ID NO: 1302 - DNA, 16 bp, Artificial sequence
  Synthetic oligonucleotide
gatgaagaatctatag

SEQ ID NO: 1303 - DNA, 16 bp, Artificial sequence
  Synthetic oligonucleotide
gtatattacaatccca

SEQ ID NO: 1304 - DNA, 16 bp, Artificial sequence
  Synthetic oligonucleotide
tctgaaaaagttatgc

SEQ ID NO: 1305 - DNA, 16 bp, Artificial sequence
  Synthetic oligonucleotide
gccgaaatactctcat

SEQ ID NO: 1306 - DNA, 16 bp, Artificial sequence
  Synthetic oligonucleotide
gtaaatcaagttgcat

SEQ ID NO: 1307 - DNA, 16 bp, Artificial sequence
  Synthetic oligonucleotide
tataataatccagaac

SEQ ID NO: 1308 - DNA, 16 bp, Artificial sequence
  Synthetic oligonucleotide
cattaagattttaacc

SEQ ID NO: 1309 - DNA, 16 bp, Artificial sequence
  Synthetic oligonucleotide
tattaaataagagctc

SEQ ID NO: 1310 - DNA, 16 bp, Artificial sequence
  Synthetic oligonucleotide
gtatttatgatgattc

SEQ ID NO: 1311 - DNA, 16 bp, Artificial sequence
  Synthetic oligonucleotide
aataaggagtaggtgg

SEQ ID NO: 1312 - DNA, 16 bp, Artificial sequence
  Synthetic oligonucleotide
actcaacaaccccaag

SEQ ID NO: 1313 - DNA, 16 bp, Artificial sequence
  Synthetic oligonucleotide
tcacaagggctaattc

SEQ ID NO: 1314 - DNA, 16 bp, Artificial sequence
  Synthetic oligonucleotide
taatttaatggcttgc

SEQ ID NO: 1315 - DNA, 16 bp, Artificial sequence
  Synthetic oligonucleotide
cgtaattagaaacttg

SEQ ID NO: 1316 - DNA, 16 bp, Artificial sequence
  Synthetic oligonucleotide
ctaaaatgaccttagc

SEQ ID NO: 1317 - DNA, 16 bp, Artificial sequence
  Synthetic oligonucleotide
aataagggactacttt

SEQ ID NO: 1318 - DNA, 16 bp, Artificial sequence
  Synthetic oligonucleotide
catcaatactgacatc

SEQ ID NO: 1319 - DNA, 16 bp, Artificial sequence
  Synthetic oligonucleotide
tgatataagttaccaa

SEQ ID NO: 1320 - DNA, 16 bp, Artificial sequence
  Synthetic oligonucleotide
tatcaagggaattatt

SEQ ID NO: 1321 - DNA, 16 bp, Artificial sequence
  Synthetic oligonucleotide
attaacctcagtgagc

SEQ ID NO: 1322 - DNA, 16 bp, Artificial sequence
  Synthetic oligonucleotide
cttaatttaactcctg

SEQ ID NO: 1323 - DNA, 16 bp, Artificial sequence
  Synthetic oligonucleotide
tattattgagttatcc

SEQ ID NO: 1324 - DNA, 16 bp, Artificial sequence
  Synthetic oligonucleotide
gctcaaaaggtctctc

SEQ ID NO: 1325 - DNA, 16 bp, Artificial sequence
  Synthetic oligonucleotide
cataattggactgtct

SEQ ID NO: 1326 - DNA, 16 bp, Artificial sequence
  Synthetic oligonucleotide
gaaatattcgagaaga

SEQ ID NO: 1327 - DNA, 16 bp, Artificial sequence
  Synthetic oligonucleotide
ccatataataacccat

SEQ ID NO: 1328 - DNA, 16 bp, Artificial sequence
  Synthetic oligonucleotide
ggactatagcccttaa

SEQ ID NO: 1329 - DNA, 16 bp, Artificial sequence
  Synthetic oligonucleotide
gaaacgggaaatcata

SEQ ID NO: 1330 - DNA, 16 bp, Artificial sequence
  Synthetic oligonucleotide
cataaacatgagtggt

SEQ ID NO: 1331 - DNA, 16 bp, Artificial sequence
  Synthetic oligonucleotide
caccaacctgttaagg

SEQ ID NO: 1332 - DNA, 16 bp, Artificial sequence
  Synthetic oligonucleotide
gcgcctgagaactttt

SEQ ID NO: 1333 - DNA, 16 bp, Artificial sequence
  Synthetic oligonucleotide
gccgaggtggagaagc

SEQ ID NO: 1334 - DNA, 16 bp, Artificial sequence
  Synthetic oligonucleotide
cccgggatccatggct

SEQ ID NO: 1335 - DNA, 16 bp, Artificial sequence
  Synthetic oligonucleotide
gagtcgggcagcttcc

SEQ ID NO: 1336 - DNA, 16 bp, Artificial sequence
  Synthetic oligonucleotide
agaagtatctctgacc

SEQ ID NO: 1337 - DNA, 16 bp, Artificial sequence
  Synthetic oligonucleotide
gtctagccaagaggtg

SEQ ID NO: 1338 - DNA, 16 bp, Artificial sequence
  Synthetic oligonucleotide
ccgcattgcctgtggc

SEQ ID NO: 1339 - DNA, 16 bp, Artificial sequence
  Synthetic oligonucleotide
atcccgggagaagaca

SEQ ID NO: 1340 - DNA, 16 bp, Artificial sequence
  Synthetic oligonucleotide
gctttggttgatagta

SEQ ID NO: 1341 - DNA, 16 bp, Artificial sequence
  Synthetic oligonucleotide
gcctgaaaactgcaac

SEQ ID NO: 1342 - DNA, 16 bp, Artificial sequence
  Synthetic oligonucleotide
acatgaagcatctgac

SEQ ID NO: 1343 - DNA, 16 bp, Artificial sequence
  Synthetic oligonucleotide
cccaccgaccctgcca

SEQ ID NO: 1344 - DNA, 16 bp, Artificial sequence
  Synthetic oligonucleotide
actacaataaccatcc

SEQ ID NO: 1345 - DNA, 16 bp, Artificial sequence
  Synthetic oligonucleotide
tagaacactaaactac

SEQ ID NO: 1346 - DNA, 16 bp, Artificial sequence
  Synthetic oligonucleotide
actgaattccaatcga

SEQ ID NO: 1347 - DNA, 16 bp, Artificial sequence
  Synthetic oligonucleotide
agtattctatccaggg

SEQ ID NO: 1348 - DNA, 16 bp, Artificial sequence
  Synthetic oligonucleotide
gagattttatgcctgt

SEQ ID NO: 1349 - DNA, 16 bp, Artificial sequence
  Synthetic oligonucleotide
gaatttcattactact

SEQ ID NO: 1350 - DNA, 16 bp, Artificial sequence
  Synthetic oligonucleotide
ccccccccaaactttc

SEQ ID NO: 1351 - DNA, 16 bp, Artificial sequence
  Synthetic oligonucleotide
gtataactgggcaaat

SEQ ID NO: 1352 - DNA, 16 bp, Artificial sequence
  Synthetic oligonucleotide
agttaagcacttttac

SEQ ID NO: 1353 - DNA, 16 bp, Artificial sequence
  Synthetic oligonucleotide
atcaaccataagtaga

SEQ ID NO: 1354 - DNA, 16 bp, Artificial sequence
  Synthetic oligonucleotide
gaaaagtgttaagcac

SEQ ID NO: 1355 - DNA, 16 bp, Artificial sequence
  Synthetic oligonucleotide
caattgttatgatagg

SEQ ID NO: 1356 - DNA, 16 bp, Artificial sequence
  Synthetic oligonucleotide
caagttacatcccgag

SEQ ID NO: 1357 - DNA, 16 bp, Artificial sequence
  Synthetic oligonucleotide
gtgattttttctgagt

SEQ ID NO: 1358 - DNA, 16 bp, Artificial sequence
  Synthetic oligonucleotide
ttattgccagttcttg

SEQ ID NO: 1359 - DNA, 16 bp, Artificial sequence
  Synthetic oligonucleotide
cataaacccacttcga

SEQ ID NO: 1360 - DNA, 16 bp, Artificial sequence
  Synthetic oligonucleotide
aaattagactccccca

SEQ ID NO: 1361 - DNA, 16 bp, Artificial sequence
  Synthetic oligonucleotide
tatacggtccataaca

SEQ ID NO: 1362 - DNA, 16 bp, Artificial sequence
  Synthetic oligonucleotide
actaaaaacattgtgg

SEQ ID NO: 1363 - DNA, 16 bp, Artificial sequence
  Synthetic oligonucleotide
tatacgagaagttgaa

SEQ ID NO: 1364 - DNA, 16 bp, Artificial sequence
  Synthetic oligonucleotide
ctttagggcaactgta

SEQ ID NO: 1365 - DNA, 16 bp, Artificial sequence
  Synthetic oligonucleotide
attaaatgagcaccac

SEQ ID NO: 1366 - DNA, 16 bp, Artificial sequence
  Synthetic oligonucleotide
gctgaaaatgctaact

SEQ ID NO: 1367 - DNA, 16 bp, Artificial sequence
  Synthetic oligonucleotide
ttattaacctggagag

SEQ ID NO: 1368 - DNA, 16 bp, Artificial sequence
  Synthetic oligonucleotide
cagcaacacctaagga

SEQ ID NO: 1369 - DNA, 16 bp, Artificial sequence
  Synthetic oligonucleotide
agttaacaaagcgggt

SEQ ID NO: 1370 - DNA, 16 bp, Artificial sequence
  Synthetic oligonucleotide
cacgaaaatagttctc

SEQ ID NO: 1371 - DNA, 16 bp, Artificial sequence
  Synthetic oligonucleotide
cattatcgcacataca

SEQ ID NO: 1372 - DNA, 16 bp, Artificial sequence
  Synthetic oligonucleotide
ctttactatctgggtc

SEQ ID NO: 1373 - DNA, 16 bp, Artificial sequence
  Synthetic oligonucleotide
ctaaataaccaaggat

SEQ ID NO: 1374 - DNA, 16 bp, Artificial sequence
  Synthetic oligonucleotide
agacaagggatgctaa

SEQ ID NO: 1375 - DNA, 16 bp, Artificial sequence
  Synthetic oligonucleotide
ttaattaagggcccac

SEQ ID NO: 1376 - DNA, 16 bp, Artificial sequence
  Synthetic oligonucleotide
tattaaggtggcttac

SEQ ID NO: 1377 - DNA, 16 bp, Artificial sequence
  Synthetic oligonucleotide
aattagcagggcagac

SEQ ID NO: 1378 - DNA, 16 bp, Artificial sequence
  Synthetic oligonucleotide
gattaacattgatact

SEQ ID NO: 1379 - DNA, 16 bp, Artificial sequence
  Synthetic oligonucleotide
cataaactctgctgtc

SEQ ID NO: 1380 - DNA, 16 bp, Artificial sequence
  Synthetic oligonucleotide
cataatcaaagggtgc

SEQ ID NO: 1381 - DNA, 16 bp, Artificial sequence
  Synthetic oligonucleotide
cataaatttcagccga

SEQ ID NO: 1382 - DNA, 16 bp, Artificial sequence
  Synthetic oligonucleotide
aattatgaatgatggg

SEQ ID NO: 1383 - DNA, 16 bp, Artificial sequence
  Synthetic oligonucleotide
catatattgtgacttc

SEQ ID NO: 1384 - DNA, 16 bp, Artificial sequence
  Synthetic oligonucleotide
actaatatgcaactct

SEQ ID NO: 1385 - DNA, 16 bp, Artificial sequence
  Synthetic oligonucleotide
gtggaaaagtatgatc

SEQ ID NO: 1386 - DNA, 16 bp, Artificial sequence
  Synthetic oligonucleotide
ctggaaaagtacattc

SEQ ID NO: 1387 - DNA, 16 bp, Artificial sequence
  Synthetic oligonucleotide
aaataaggagtaggtg

SEQ ID NO: 1388 - DNA, 16 bp, Artificial sequence
  Synthetic oligonucleotide
agtcaatagcaatcac

SEQ ID NO: 1389 - DNA, 16 bp, Artificial sequence
  Synthetic oligonucleotide
ccgcaacaccattctt

SEQ ID NO: 1390 - DNA, 16 bp, Artificial sequence
  Synthetic oligonucleotide
gtacaaaatctccagg

SEQ ID NO: 1391 - DNA, 16 bp, Artificial sequence
  Synthetic oligonucleotide
cttaaattctcttacg

SEQ ID NO: 1392 - DNA, 16 bp, Artificial sequence
  Synthetic oligonucleotide
tctaaaatgaccttag

SEQ ID NO: 1393 - DNA, 16 bp, Artificial sequence
  Synthetic oligonucleotide
aaataagggactactt

SEQ ID NO: 1394 - DNA, 16 bp, Artificial sequence
  Synthetic oligonucleotide
catactaatttggtaa

SEQ ID NO: 1395 - DNA, 16 bp, Artificial sequence
  Synthetic oligonucleotide
ccccaaggacttgcca

SEQ ID NO: 1396 - DNA, 16 bp, Artificial sequence
  Synthetic oligonucleotide
tattatcaagggaatt

SEQ ID NO: 1397 - DNA, 16 bp, Artificial sequence
  Synthetic oligonucleotide
aattaacctcagtgag

SEQ ID NO: 1398 - DNA, 16 bp, Artificial sequence
  Synthetic oligonucleotide
ccccaacaagttcctg

SEQ ID NO: 1399 - DNA, 16 bp, Artificial sequence
  Synthetic oligonucleotide
gcttattattgagtta

SEQ ID NO: 1400 - DNA, 16 bp, Artificial sequence
  Synthetic oligonucleotide
ctaataatggaagagt

SEQ ID NO: 1401 - DNA, 16 bp, Artificial sequence
  Synthetic oligonucleotide
tccaaaaacttcttag

SEQ ID NO: 1402 - DNA, 16 bp, Artificial sequence
  Synthetic oligonucleotide
atcgaaatattcgaga

SEQ ID NO: 1403 - DNA, 16 bp, Artificial sequence
  Synthetic oligonucleotide
aattatgacctccatg

SEQ ID NO: 1404 - DNA, 16 bp, Artificial sequence
  Synthetic oligonucleotide
gtaatattgcaatctg

SEQ ID NO: 1405 - DNA, 16 bp, Artificial sequence
  Synthetic oligonucleotide
aaacgaaacgggaaat

SEQ ID NO: 1406 - DNA, 16 bp, Artificial sequence
  Synthetic oligonucleotide
cataataagactaaac

SEQ ID NO: 1407 - DNA, 16 bp, Artificial sequence
  Synthetic oligonucleotide
gtgcaaaatacctttg

SEQ ID NO: 1408 - DNA, 16 bp, Artificial sequence
  Synthetic oligonucleotide
cactcggacctgcggc

SEQ ID NO: 1409 - DNA, 16 bp, Artificial sequence
  Synthetic oligonucleotide
ggccgaggtggagaag

SEQ ID NO: 1410 - DNA, 16 bp, Artificial sequence
  Synthetic oligonucleotide
gcccgggatccatggc

SEQ ID NO: 1411 - DNA, 16 bp, Artificial sequence
  Synthetic oligonucleotide
tccggcggcttgaaga

SEQ ID NO: 1412 - DNA, 16 bp, Artificial sequence
  Synthetic oligonucleotide
aagaagtatctctgac

SEQ ID NO: 1413 - DNA, 16 bp, Artificial sequence
  Synthetic oligonucleotide
cttgggtctagccaag

SEQ ID NO: 1414 - DNA, 16 bp, Artificial sequence
  Synthetic oligonucleotide
tccgcattgcctgtgg

SEQ ID NO: 1415 - DNA, 16 bp, Artificial sequence
  Synthetic oligonucleotide
catcccgggagaagac

SEQ ID NO: 1416 - DNA, 16 bp, Artificial sequence
  Synthetic oligonucleotide
tgctttggttgatagt

SEQ ID NO: 1417 - DNA, 16 bp, Artificial sequence
  Synthetic oligonucleotide
aaagtatcttgctgga

SEQ ID NO: 1418 - DNA, 16 bp, Artificial sequence
  Synthetic oligonucleotide
gacatgaagcatctga

SEQ ID NO: 1419 - DNA, 16 bp, Artificial sequence
  Synthetic oligonucleotide
ccccccaccgaccctg

SEQ ID NO: 1420 - DNA, 16 bp, Artificial sequence
  Synthetic oligonucleotide
aactacaataaccatc

SEQ ID NO: 1421 - DNA, 16 bp, Artificial sequence
  Synthetic oligonucleotide
taatagctctttctag

SEQ ID NO: 1422 - DNA, 16 bp, Artificial sequence
  Synthetic oligonucleotide
cactgaattccaatcg

SEQ ID NO: 1423 - DNA, 16 bp, Artificial sequence
  Synthetic oligonucleotide
cttatagtattctatc

SEQ ID NO: 1424 - DNA, 16 bp, Artificial sequence
  Synthetic oligonucleotide
agagattttatgcctg

SEQ ID NO: 1425 - DNA, 16 bp, Artificial sequence
  Synthetic oligonucleotide
ggtagaatttcattac

SEQ ID NO: 1426 - DNA, 16 bp, Artificial sequence
  Synthetic oligonucleotide
cccccccccaaacttt

SEQ ID NO: 1427 - DNA, 16 bp, Artificial sequence
  Synthetic oligonucleotide
ggtataactgggcaaa

SEQ ID NO: 1428 - DNA, 16 bp, Artificial sequence
  Synthetic oligonucleotide
cagttaagcactttta

SEQ ID NO: 1429 - DNA, 16 bp, Artificial sequence
  Synthetic oligonucleotide
catcaaccataagtag

SEQ ID NO: 1430 - DNA, 16 bp, Artificial sequence
  Synthetic oligonucleotide
tagaaaagtgttaagc

SEQ ID NO: 1431 - DNA, 16 bp, Artificial sequence
  Synthetic oligonucleotide
acaattgttatgatag

SEQ ID NO: 1432 - DNA, 16 bp, Artificial sequence
  Synthetic oligonucleotide
tcaagttacatcccga

SEQ ID NO: 1433 - DNA, 16 bp, Artificial sequence
  Synthetic oligonucleotide
atcaggttaagtgatt

SEQ ID NO: 1434 - DNA, 16 bp, Artificial sequence
  Synthetic oligonucleotide
accttttattgccagt

SEQ ID NO: 1435 - DNA, 16 bp, Artificial sequence
  Synthetic oligonucleotide
ggagaaataaaagtcg

SEQ ID NO: 1436 - DNA, 16 bp, Artificial sequence
  Synthetic oligonucleotide
aaaattagactccccc

SEQ ID NO: 1437 - DNA, 16 bp, Artificial sequence
  Synthetic oligonucleotide
caactatacggtccat

SEQ ID NO: 1438 - DNA, 16 bp, Artificial sequence
  Synthetic oligonucleotide
gactaaaaacattgtg

SEQ ID NO: 1439 - DNA, 16 bp, Artificial sequence
  Synthetic oligonucleotide
gatatacgagaagttg

SEQ ID NO: 1440 - DNA, 16 bp, Artificial sequence
  Synthetic oligonucleotide
cctgaaaagacagtcc

SEQ ID NO: 1441 - DNA, 16 bp, Artificial sequence
  Synthetic oligonucleotide
tattaaatgagcacca

SEQ ID NO: 1442 - DNA, 16 bp, Artificial sequence
  Synthetic oligonucleotide
cttaaacaggtgccaa

SEQ ID NO: 1443 - DNA, 16 bp, Artificial sequence
  Synthetic oligonucleotide
ctttattaacctggag

SEQ ID NO: 1444 - DNA, 16 bp, Artificial sequence
  Synthetic oligonucleotide
ccttaaagcttccacc

SEQ ID NO: 1445 - DNA, 16 bp, Artificial sequence
  Synthetic oligonucleotide
ttaataatctaccagt

SEQ ID NO: 1446 - DNA, 16 bp, Artificial sequence
  Synthetic oligonucleotide
acacgaaaatagttct

SEQ ID NO: 1447 - DNA, 16 bp, Artificial sequence
  Synthetic oligonucleotide
tatatatggcccttta

SEQ ID NO: 1448 - DNA, 16 bp, Artificial sequence
  Synthetic oligonucleotide
cttaactaacttgacc

SEQ ID NO: 1449 - DNA, 16 bp, Artificial sequence
  Synthetic oligonucleotide
gtttatagacaagtca

SEQ ID NO: 1450 - DNA, 16 bp, Artificial sequence
  Synthetic oligonucleotide
tctcaacaatttgcta

SEQ ID NO: 1451 - DNA, 16 bp, Artificial sequence
  Synthetic oligonucleotide
tttaattaagggccca

SEQ ID NO: 1452 - DNA, 16 bp, Artificial sequence
  Synthetic oligonucleotide
atattaaggtggctta

SEQ ID NO: 1453 - DNA, 16 bp, Artificial sequence
  Synthetic oligonucleotide
catcaaaattagcagg

SEQ ID NO: 1454 - DNA, 16 bp, Artificial sequence
  Synthetic oligonucleotide
tcttatacctatcttc

SEQ ID NO: 1455 - DNA, 16 bp, Artificial sequence
  Synthetic oligonucleotide
tattaagacgaatcca

SEQ ID NO: 1456 - DNA, 16 bp, Artificial sequence
  Synthetic oligonucleotide
gtaattacagtgtctc

SEQ ID NO: 1457 - DNA, 16 bp, Artificial sequence
  Synthetic oligonucleotide
ccactaaaaccaagtt

SEQ ID NO: 1458 - DNA, 16 bp, Artificial sequence
  Synthetic oligonucleotide
caattatgaatgatgg

SEQ ID NO: 1459 - DNA, 16 bp, Artificial sequence
  Synthetic oligonucleotide
tattaggtttcccgtt

SEQ ID NO: 1460 - DNA, 16 bp, Artificial sequence
  Synthetic oligonucleotide
tataaagcagggcatt

SEQ ID NO: 1461 - DNA, 16 bp, Artificial sequence
  Synthetic oligonucleotide
gattaagagcctatct

SEQ ID NO: 1462 - DNA, 16 bp, Artificial sequence
  Synthetic oligonucleotide
gattatcaagtagttt

SEQ ID NO: 1463 - DNA, 16 bp, Artificial sequence
  Synthetic oligonucleotide
gaaataaggagtaggt

SEQ ID NO: 1464 - DNA, 16 bp, Artificial sequence
  Synthetic oligonucleotide
tgactatacatggtga

SEQ ID NO: 1465 - DNA, 16 bp, Artificial sequence
  Synthetic oligonucleotide
aaaaaattccgcaaca

SEQ ID NO: 1466 - DNA, 16 bp, Artificial sequence
  Synthetic oligonucleotide
tttaaacctgagactc

SEQ ID NO: 1467 - DNA, 16 bp, Artificial sequence
  Synthetic oligonucleotide
aggcaagaattgggta

SEQ ID NO: 1468 - DNA, 16 bp, Artificial sequence
  Synthetic oligonucleotide
attagtaatgcacagg

SEQ ID NO: 1469 - DNA, 16 bp, Artificial sequence
  Synthetic oligonucleotide
cttaacaaatcagccc

SEQ ID NO: 1470 - DNA, 16 bp, Artificial sequence
  Synthetic oligonucleotide
gattagagttgggcat

SEQ ID NO: 1471 - DNA, 16 bp, Artificial sequence
  Synthetic oligonucleotide
atttacaccaccgccc

SEQ ID NO: 1472 - DNA, 16 bp, Artificial sequence
  Synthetic oligonucleotide
ctattatcaagggaat

SEQ ID NO: 1473 - DNA, 16 bp, Artificial sequence
  Synthetic oligonucleotide
gaattaacctcagtga

SEQ ID NO: 1474 - DNA, 16 bp, Artificial sequence
  Synthetic oligonucleotide
agacaatagtctgggc

SEQ ID NO: 1475 - DNA, 16 bp, Artificial sequence
  Synthetic oligonucleotide
tatattagtgccccct

SEQ ID NO: 1476 - DNA, 16 bp, Artificial sequence
  Synthetic oligonucleotide
gctaataatggaagag

SEQ ID NO: 1477 - DNA, 16 bp, Artificial sequence
  Synthetic oligonucleotide
gtttaacaaacttgta

SEQ ID NO: 1478 - DNA, 16 bp, Artificial sequence
  Synthetic oligonucleotide
gatcgaaatattcgag

SEQ ID NO: 1479 - DNA, 16 bp, Artificial sequence
  Synthetic oligonucleotide
gaattatgacctccat

SEQ ID NO: 1480 - DNA, 16 bp, Artificial sequence
  Synthetic oligonucleotide
taaactaatcccatat

SEQ ID NO: 1481 - DNA, 16 bp, Artificial sequence
  Synthetic oligonucleotide
gaaacgaaacgggaaa

SEQ ID NO: 1482 - DNA, 16 bp, Artificial sequence
  Synthetic oligonucleotide
gataagcaccaccata

SEQ ID NO: 1483 - DNA, 16 bp, Artificial sequence
  Synthetic oligonucleotide
taccaacctgtatcca

SEQ ID NO: 1484 - DNA, 16 bp, Artificial sequence
  Synthetic oligonucleotide
gcactcggacctgcgg

SEQ ID NO: 1485 - DNA, 16 bp, Artificial sequence
  Synthetic oligonucleotide
gggccgaggtggagaa

SEQ ID NO: 1486 - DNA, 16 bp, Artificial sequence
  Synthetic oligonucleotide
ccggttgaggcggcgg

SEQ ID NO: 1487 - DNA, 16 bp, Artificial sequence
  Synthetic oligonucleotide
gctccggcggcttgaa

SEQ ID NO: 1488 - DNA, 16 bp, Artificial sequence
  Synthetic oligonucleotide
atcgatgtgatttaag

SEQ ID NO: 1489 - DNA, 16 bp, Artificial sequence
  Synthetic oligonucleotide
gtcaagccttgggtct

SEQ ID NO: 1490 - DNA, 16 bp, Artificial sequence
  Synthetic oligonucleotide
ttccgcattgcctgtg

SEQ ID NO: 1491 - DNA, 16 bp, Artificial sequence
  Synthetic oligonucleotide
agacatcccgggagaa

SEQ ID NO: 1492 - DNA, 16 bp, Artificial sequence
  Synthetic oligonucleotide
gcagggtgctttggtt

SEQ ID NO: 1493 - DNA, 16 bp, Artificial sequence
  Synthetic oligonucleotide
taaagtatcttgctgg

SEQ ID NO: 1494 - DNA, 16 bp, Artificial sequence
  Synthetic oligonucleotide
ctgtgacatgaagcat

SEQ ID NO: 1495 - DNA, 16 bp, Artificial sequence
  Synthetic oligonucleotide
cccccccaccgaccct

SEQ ID NO: 1496 - DNA, 16 bp, Artificial sequence
  Synthetic oligonucleotide
caactacaataaccat

SEQ ID NO: 1497 - DNA, 16 bp, Artificial sequence
  Synthetic oligonucleotide
gtaatagctctttcta

SEQ ID NO: 1498 - DNA, 16 bp, Artificial sequence
  Synthetic oligonucleotide
aacctactcactgaat

SEQ ID NO: 1499 - DNA, 16 bp, Artificial sequence
  Synthetic oligonucleotide
gctaactcaaaacctt

SEQ ID NO: 1500 - DNA, 16 bp, Artificial sequence
  Synthetic oligonucleotide
catagcagcttttgcc

SEQ ID NO: 1501 - DNA, 16 bp, Artificial sequence
  Synthetic oligonucleotide
cattctaggtagaatt

SEQ ID NO: 1502 - DNA, 16 bp, Artificial sequence
  Synthetic oligonucleotide
ccccctaaatcttcac

SEQ ID NO: 1503 - DNA, 16 bp, Artificial sequence
  Synthetic oligonucleotide
gaggtataactgggca

SEQ ID NO: 1504 - DNA, 16 bp, Artificial sequence
  Synthetic oligonucleotide
caaccaagaagcagtt

SEQ ID NO: 1505 - DNA, 16 bp, Artificial sequence
  Synthetic oligonucleotide
ctccatcaaccataag

SEQ ID NO: 1506 - DNA, 16 bp, Artificial sequence
  Synthetic oligonucleotide
gagcactcatttctca

SEQ ID NO: 1507 - DNA, 16 bp, Artificial sequence
  Synthetic oligonucleotide
gtgcattaaagaattc

SEQ ID NO: 1508 - DNA, 16 bp, Artificial sequence
  Synthetic oligonucleotide
tagcctgaagcaagtt

SEQ ID NO: 1509 - DNA, 16 bp, Artificial sequence
  Synthetic oligonucleotide
ctcaagttacatcccg

SEQ ID NO: 1510 - DNA, 16 bp, Artificial sequence
  Synthetic oligonucleotide
catcaggttaagtgat

SEQ ID NO: 1511 - DNA, 16 bp, Artificial sequence
  Synthetic oligonucleotide
caccttttattgccag

SEQ ID NO: 1512 - DNA, 16 bp, Artificial sequence
  Synthetic oligonucleotide
cagaataagtatgatt

SEQ ID NO: 1513 - DNA, 16 bp, Artificial sequence
  Synthetic oligonucleotide
taaaattagactcccc

SEQ ID NO: 1514 - DNA, 16 bp, Artificial sequence
  Synthetic oligonucleotide
caccaaaagcttagtt

SEQ ID NO: 1515 - DNA, 16 bp, Artificial sequence
  Synthetic oligonucleotide
taggaatatgggtagt

SEQ ID NO: 1516 - DNA, 16 bp, Artificial sequence
  Synthetic oligonucleotide
ccttattagtcagttc

SEQ ID NO: 1517 - DNA, 16 bp, Artificial sequence
  Synthetic oligonucleotide
actgaaagattccatg

SEQ ID NO: 1518 - DNA, 16 bp, Artificial sequence
  Synthetic oligonucleotide
ctattaaatgagcacc

SEQ ID NO: 1519 - DNA, 16 bp, Artificial sequence
  Synthetic oligonucleotide
tcttaaacaggtgcca

SEQ ID NO: 1520 - DNA, 16 bp, Artificial sequence
  Synthetic oligonucleotide
gatgtgatctgtgaga

SEQ ID NO: 1521 - DNA, 16 bp, Artificial sequence
  Synthetic oligonucleotide
taaactaatctacaac

SEQ ID NO: 1522 - DNA, 16 bp, Artificial sequence
  Synthetic oligonucleotide
cttaataatctaccag

SEQ ID NO: 1523 - DNA, 16 bp, Artificial sequence
  Synthetic oligonucleotide
cattacttagggctta

SEQ ID NO: 1524 - DNA, 16 bp, Artificial sequence
  Synthetic oligonucleotide
catatatatggccctt

SEQ ID NO: 1525 - DNA, 16 bp, Artificial sequence
  Synthetic oligonucleotide
taactaaactgattcc

SEQ ID NO: 1526 - DNA, 16 bp, Artificial sequence
  Synthetic oligonucleotide
cttaatccaaagcttc

SEQ ID NO: 1527 - DNA, 16 bp, Artificial sequence
  Synthetic oligonucleotide
cttaattggtaactga

SEQ ID NO: 1528 - DNA, 16 bp, Artificial sequence
  Synthetic oligonucleotide
atttaattaagggccc

SEQ ID NO: 1529 - DNA, 16 bp, Artificial sequence
  Synthetic oligonucleotide
gatattaaggtggctt

SEQ ID NO: 1530 - DNA, 16 bp, Artificial sequence
  Synthetic oligonucleotide
gtaataatcaccttac

SEQ ID NO: 1531 - DNA, 16 bp, Artificial sequence
  Synthetic oligonucleotide
cataatcaaaatgggc

SEQ ID NO: 1532 - DNA, 16 bp, Artificial sequence
  Synthetic oligonucleotide
ctattaagacgaatcc

SEQ ID NO: 1533 - DNA, 16 bp, Artificial sequence
  Synthetic oligonucleotide
taaacgagtaatgact

SEQ ID NO: 1534 - DNA, 16 bp, Artificial sequence
  Synthetic oligonucleotide
ctaaaaccggctggac

SEQ ID NO: 1535 - DNA, 16 bp, Artificial sequence
  Synthetic oligonucleotide
gaggaacaagatctca

SEQ ID NO: 1536 - DNA, 16 bp, Artificial sequence
  Synthetic oligonucleotide
cttaatttacctgaac

SEQ ID NO: 1537 - DNA, 16 bp, Artificial sequence
  Synthetic oligonucleotide
gtataaagcagggcat

SEQ ID NO: 1538 - DNA, 16 bp, Artificial sequence
  Synthetic oligonucleotide
ctttatagcagatgcc

SEQ ID NO: 1539 - DNA, 16 bp, Artificial sequence
  Synthetic oligonucleotide
gaataaagaagtcacc

SEQ ID NO: 1540 - DNA, 16 bp, Artificial sequence
  Synthetic oligonucleotide
tgacaaaacaggcacc

SEQ ID NO: 1541 - DNA, 16 bp, Artificial sequence
  Synthetic oligonucleotide
gtatatcaaacctttt

SEQ ID NO: 1542 - DNA, 16 bp, Artificial sequence
  Synthetic oligonucleotide
ggaaaaaaattccgca

SEQ ID NO: 1543 - DNA, 16 bp, Artificial sequence
  Synthetic oligonucleotide
cattaggccttttact

SEQ ID NO: 1544 - DNA, 16 bp, Artificial sequence
  Synthetic oligonucleotide
gattagagctgtattc

SEQ ID NO: 1545 - DNA, 16 bp, Artificial sequence
  Synthetic oligonucleotide
tattagtaatgcacag

SEQ ID NO: 1546 - DNA, 16 bp, Artificial sequence
  Synthetic oligonucleotide
gcttaacaaatcagcc

SEQ ID NO: 1547 - DNA, 16 bp, Artificial sequence
  Synthetic oligonucleotide
cataattgacaggtat

SEQ ID NO: 1548 - DNA, 16 bp, Artificial sequence
  Synthetic oligonucleotide
aaatttacaccaccgc

SEQ ID NO: 1549 - DNA, 16 bp, Artificial sequence
  Synthetic oligonucleotide
tatcaaaagtccatcc

SEQ ID NO: 1550 - DNA, 16 bp, Artificial sequence
  Synthetic oligonucleotide
ttagaaatggactggg

SEQ ID NO: 1551 - DNA, 16 bp, Artificial sequence
  Synthetic oligonucleotide
aataaccaagtgagtt

SEQ ID NO: 1552 - DNA, 16 bp, Artificial sequence
  Synthetic oligonucleotide
gtatattagtgccccc

SEQ ID NO: 1553 - DNA, 16 bp, Artificial sequence
  Synthetic oligonucleotide
gataagcaaggttctc

SEQ ID NO: 1554 - DNA, 16 bp, Artificial sequence
  Synthetic oligonucleotide
atttatcctagttacc

SEQ ID NO: 1555 - DNA, 16 bp, Artificial sequence
  Synthetic oligonucleotide
caaatatagttagcct

SEQ ID NO: 1556 - DNA, 16 bp, Artificial sequence
  Synthetic oligonucleotide
cctgaaccttctggat

SEQ ID NO: 1557 - DNA, 16 bp, Artificial sequence
  Synthetic oligonucleotide
actaaatacttttagc

SEQ ID NO: 1558 - DNA, 16 bp, Artificial sequence
  Synthetic oligonucleotide
gtacgaaacgaaacgg

SEQ ID NO: 1559 - DNA, 16 bp, Artificial sequence
  Synthetic oligonucleotide
acacaacacgacagca

SEQ ID NO: 1560 - DNA, 16 bp, Artificial sequence
  Synthetic oligonucleotide
gtggaatagcagccat

SEQ ID NO: 1561 - DNA, 16 bp, Artificial sequence
  Synthetic oligonucleotide
gcgaggcactcggacc

SEQ ID NO: 1562 - DNA, 16 bp, Artificial sequence
  Synthetic oligonucleotide
cgggccgaggtggaga

SEQ ID NO: 1563 - DNA, 16 bp, Artificial sequence
  Synthetic oligonucleotide
gccggttgaggcggcg

SEQ ID NO: 1564 - DNA, 16 bp, Artificial sequence
  Synthetic oligonucleotide
gatttgggctccggcg

SEQ ID NO: 1565 - DNA, 16 bp, Artificial sequence
  Synthetic oligonucleotide
gatcgatgtgatttaa

SEQ ID NO: 1566 - DNA, 16 bp, Artificial sequence
  Synthetic oligonucleotide
ggtcaagccttgggtc

SEQ ID NO: 1567 - DNA, 16 bp, Artificial sequence
  Synthetic oligonucleotide
atattccgcattgcct

SEQ ID NO: 1568 - DNA, 16 bp, Artificial sequence
  Synthetic oligonucleotide
tgagacatcccgggag

SEQ ID NO: 1569 - DNA, 16 bp, Artificial sequence
  Synthetic oligonucleotide
aacggttctgctgtga

SEQ ID NO: 1570 - DNA, 16 bp, Artificial sequence
  Synthetic oligonucleotide
gattaaagtatcttgc

SEQ ID NO: 1571 - DNA, 16 bp, Artificial sequence
  Synthetic oligonucleotide
gctgtgacatgaagca

SEQ ID NO: 1572 - DNA, 16 bp, Artificial sequence
  Synthetic oligonucleotide
aacccccccaccgacc

SEQ ID NO: 1573 - DNA, 16 bp, Artificial sequence
  Synthetic oligonucleotide
tcgagatttaaataag

SEQ ID NO: 1574 - DNA, 16 bp, Artificial sequence
  Synthetic oligonucleotide
agtaatagctctttct

SEQ ID NO: 1575 - DNA, 16 bp, Artificial sequence
  Synthetic oligonucleotide
gaacctactcactgaa

SEQ ID NO: 1576 - DNA, 16 bp, Artificial sequence
  Synthetic oligonucleotide
cagctaactcaaaacc

SEQ ID NO: 1577 - DNA, 16 bp, Artificial sequence
  Synthetic oligonucleotide
tcatagcagcttttgc

SEQ ID NO: 1578 - DNA, 16 bp, Artificial sequence
  Synthetic oligonucleotide
gcattctaggtagaat

SEQ ID NO: 1579 - DNA, 16 bp, Artificial sequence
  Synthetic oligonucleotide
gtccccctaaatcttc

SEQ ID NO: 1580 - DNA, 16 bp, Artificial sequence
  Synthetic oligonucleotide
tgaggtataactgggc

SEQ ID NO: 1581 - DNA, 16 bp, Artificial sequence
  Synthetic oligonucleotide
acaaccaagaagcagt

SEQ ID NO: 1582 - DNA, 16 bp, Artificial sequence
  Synthetic oligonucleotide
atcaatgtgctccatc

SEQ ID NO: 1583 - DNA, 16 bp, Artificial sequence
  Synthetic oligonucleotide
cctgagcactcatttc

SEQ ID NO: 1584 - DNA, 16 bp, Artificial sequence
  Synthetic oligonucleotide
tttgacaagtgtgcat

SEQ ID NO: 1585 - DNA, 16 bp, Artificial sequence
  Synthetic oligonucleotide
gtttagcctgaagcaa

SEQ ID NO: 1586 - DNA, 16 bp, Artificial sequence
  Synthetic oligonucleotide
actcaagttacatccc

SEQ ID NO: 1587 - DNA, 16 bp, Artificial sequence
  Synthetic oligonucleotide
gtttttgtcatcaggt

SEQ ID NO: 1588 - DNA, 16 bp, Artificial sequence
  Synthetic oligonucleotide
atcaccttttattgcc

SEQ ID NO: 1589 - DNA, 16 bp, Artificial sequence
  Synthetic oligonucleotide
tcagaataagtatgat

SEQ ID NO: 1590 - DNA, 16 bp, Artificial sequence
  Synthetic oligonucleotide
gtaaaattagactccc

SEQ ID NO: 1591 - DNA, 16 bp, Artificial sequence
  Synthetic oligonucleotide
attacaaagacagccc

SEQ ID NO: 1592 - DNA, 16 bp, Artificial sequence
  Synthetic oligonucleotide
atataggaatatgggt

SEQ ID NO: 1593 - DNA, 16 bp, Artificial sequence
  Synthetic oligonucleotide
accctatatcctatat

SEQ ID NO: 1594 - DNA, 16 bp, Artificial sequence
  Synthetic oligonucleotide
aattacccgggaacta

SEQ ID NO: 1595 - DNA, 16 bp, Artificial sequence
  Synthetic oligonucleotide
actgaacacaggctac

SEQ ID NO: 1596 - DNA, 16 bp, Artificial sequence
  Synthetic oligonucleotide
taaacggtttatattc

SEQ ID NO: 1597 - DNA, 16 bp, Artificial sequence
  Synthetic oligonucleotide
aattagccagcatgca

SEQ ID NO: 1598 - DNA, 16 bp, Artificial sequence
  Synthetic oligonucleotide
cacgggtaccagaaaa

SEQ ID NO: 1599 - DNA, 16 bp, Artificial sequence
  Synthetic oligonucleotide
gcttaataatctacca

SEQ ID NO: 1600 - DNA, 16 bp, Artificial sequence
  Synthetic oligonucleotide
gagaataagcaatcag

SEQ ID NO: 1601 - DNA, 16 bp, Artificial sequence
  Synthetic oligonucleotide
tagcaatagtcaggta

SEQ ID NO: 1602 - DNA, 16 bp, Artificial sequence
  Synthetic oligonucleotide
ctaactaaactgattc

SEQ ID NO: 1603 - DNA, 16 bp, Artificial sequence
  Synthetic oligonucleotide
ccactaaaccacctaa

SEQ ID NO: 1604 - DNA, 16 bp, Artificial sequence
  Synthetic oligonucleotide
ttatataatgcaggct

SEQ ID NO: 1605 - DNA, 16 bp, Artificial sequence
  Synthetic oligonucleotide
atcgaagggcaaactc

SEQ ID NO: 1606 - DNA, 16 bp, Artificial sequence
  Synthetic oligonucleotide
gctaaataaaggttac

SEQ ID NO: 1607 - DNA, 16 bp, Artificial sequence
  Synthetic oligonucleotide
cgtaataatcacctta

SEQ ID NO: 1608 - DNA, 16 bp, Artificial sequence
  Synthetic oligonucleotide
atctataacccttatt

SEQ ID NO: 1609 - DNA, 16 bp, Artificial sequence
  Synthetic oligonucleotide
aaaacggtttttctaa

SEQ ID NO: 1610 - DNA, 16 bp, Artificial sequence
  Synthetic oligonucleotide
gacaataaacatcacc

SEQ ID NO: 1611 - DNA, 16 bp, Artificial sequence
  Synthetic oligonucleotide
ctttactacatatagc

SEQ ID NO: 1612 - DNA, 16 bp, Artificial sequence
  Synthetic oligonucleotide
cataattatactgatc

SEQ ID NO: 1613 - DNA, 16 bp, Artificial sequence
  Synthetic oligonucleotide
attttatagggccatt

SEQ ID NO: 1614 - DNA, 16 bp, Artificial sequence
  Synthetic oligonucleotide
tagtataaagcagggc

SEQ ID NO: 1615 - DNA, 16 bp, Artificial sequence
  Synthetic oligonucleotide
gattacaatgggcagt

SEQ ID NO: 1616 - DNA, 16 bp, Artificial sequence
  Synthetic oligonucleotide
attaactacaccacga

SEQ ID NO: 1617 - DNA, 16 bp, Artificial sequence
  Synthetic oligonucleotide
agttatacacaaccac

SEQ ID NO: 1618 - DNA, 16 bp, Artificial sequence
  Synthetic oligonucleotide
tattaggaacagatca

SEQ ID NO: 1619 - DNA, 16 bp, Artificial sequence
  Synthetic oligonucleotide
attaaaagtcgggcca

SEQ ID NO: 1620 - DNA, 16 bp, Artificial sequence
  Synthetic oligonucleotide
agcgaaaataacatta

SEQ ID NO: 1621 - DNA, 16 bp, Artificial sequence
  Synthetic oligonucleotide
cttaaagaagcactag

SEQ ID NO: 1622 - DNA, 16 bp, Artificial sequence
  Synthetic oligonucleotide
cacaaaaactggtctg

SEQ ID NO: 1623 - DNA, 16 bp, Artificial sequence
  Synthetic oligonucleotide
acgaaatagtaactgt

SEQ ID NO: 1624 - DNA, 16 bp, Artificial sequence
  Synthetic oligonucleotide
caacaacctcatgtaa

SEQ ID NO: 1625 - DNA, 16 bp, Artificial sequence
  Synthetic oligonucleotide
caaatttacaccaccg

SEQ ID NO: 1626 - DNA, 16 bp, Artificial sequence
  Synthetic oligonucleotide
gattacactatcaaaa

SEQ ID NO: 1627 - DNA, 16 bp, Artificial sequence
  Synthetic oligonucleotide
gtaatacaccatttgg

SEQ ID NO: 1628 - DNA, 16 bp, Artificial sequence
  Synthetic oligonucleotide
acccaataaccaagtg

SEQ ID NO: 1629 - DNA, 16 bp, Artificial sequence
  Synthetic oligonucleotide
tataaagacccaatgc

SEQ ID NO: 1630 - DNA, 16 bp, Artificial sequence
  Synthetic oligonucleotide
actgaaccgctgcctc

SEQ ID NO: 1631 - DNA, 16 bp, Artificial sequence
  Synthetic oligonucleotide
ctatttatcctagtta

SEQ ID NO: 1632 - DNA, 16 bp, Artificial sequence
  Synthetic oligonucleotide
tattaatcaaataggg

SEQ ID NO: 1633 - DNA, 16 bp, Artificial sequence
  Synthetic oligonucleotide
acttaacctgacagct

SEQ ID NO: 1634 - DNA, 16 bp, Artificial sequence
  Synthetic oligonucleotide
ctttaaagtgtatgtc

SEQ ID NO: 1635 - DNA, 16 bp, Artificial sequence
  Synthetic oligonucleotide
gccaataagataagaa

SEQ ID NO: 1636 - DNA, 16 bp, Artificial sequence
  Synthetic oligonucleotide
aattatatgcagcagc

SEQ ID NO: 1637 - DNA, 16 bp, Artificial sequence
  Synthetic oligonucleotide
atgtataaataccagg

SEQ ID NO: 1638 - DNA, 16 bp, Artificial sequence
  Synthetic oligonucleotide
tgcgaggcactcggac

SEQ ID NO: 1639 - DNA, 16 bp, Artificial sequence
  Synthetic oligonucleotide
cacgggccgaggtgga

SEQ ID NO: 1640 - DNA, 16 bp, Artificial sequence
  Synthetic oligonucleotide
ggccggttgaggcggc

SEQ ID NO: 1641 - DNA, 16 bp, Artificial sequence
  Synthetic oligonucleotide
ggatttgggctccggc

SEQ ID NO: 1642 - DNA, 16 bp, Artificial sequence
  Synthetic oligonucleotide
tgatcgatgtgattta

SEQ ID NO: 1643 - DNA, 16 bp, Artificial sequence
  Synthetic oligonucleotide
gagggtcaagccttgg

SEQ ID NO: 1644 - DNA, 16 bp, Artificial sequence
  Synthetic oligonucleotide
tgatattccgcattgc

SEQ ID NO: 1645 - DNA, 16 bp, Artificial sequence
  Synthetic oligonucleotide
tctgagctattggtcg

SEQ ID NO: 1646 - DNA, 16 bp, Artificial sequence
  Synthetic oligonucleotide
aaacggttctgctgtg

SEQ ID NO: 1647 - DNA, 16 bp, Artificial sequence
  Synthetic oligonucleotide
ggattaaagtatcttg

SEQ ID NO: 1648 - DNA, 16 bp, Artificial sequence
  Synthetic oligonucleotide
caaactaaatgctgtg

SEQ ID NO: 1649 - DNA, 16 bp, Artificial sequence
  Synthetic oligonucleotide
caacccccccaccgac

SEQ ID NO: 1650 - DNA, 16 bp, Artificial sequence
  Synthetic oligonucleotide
aatcgagatttaaata

SEQ ID NO: 1651 - DNA, 16 bp, Artificial sequence
  Synthetic oligonucleotide
cagtaatagctctttc

SEQ ID NO: 1652 - DNA, 16 bp, Artificial sequence
  Synthetic oligonucleotide
tgaacctactcactga

SEQ ID NO: 1653 - DNA, 16 bp, Artificial sequence
  Synthetic oligonucleotide
ccagctaactcaaaac

SEQ ID NO: 1654 - DNA, 16 bp, Artificial sequence
  Synthetic oligonucleotide
gaggcttttcatagca

SEQ ID NO: 1655 - DNA, 16 bp, Artificial sequence
  Synthetic oligonucleotide
ttgcattctaggtaga

SEQ ID NO: 1656 - DNA, 16 bp, Artificial sequence
  Synthetic oligonucleotide
atcaaggtccccctaa

SEQ ID NO: 1657 - DNA, 16 bp, Artificial sequence
  Synthetic oligonucleotide
acactgaggtataact

SEQ ID NO: 1658 - DNA, 16 bp, Artificial sequence
  Synthetic oligonucleotide
tacccaatacaaccaa

SEQ ID NO: 1659 - DNA, 16 bp, Artificial sequence
  Synthetic oligonucleotide
aatcaatgtgctccat

SEQ ID NO: 1660 - DNA, 16 bp, Artificial sequence
  Synthetic oligonucleotide
acctgagcactcattt

SEQ ID NO: 1661 - DNA, 16 bp, Artificial sequence
  Synthetic oligonucleotide
acattggtactatata

SEQ ID NO: 1662 - DNA, 16 bp, Artificial sequence
  Synthetic oligonucleotide
agtttagcctgaagca

SEQ ID NO: 1663 - DNA, 16 bp, Artificial sequence
  Synthetic oligonucleotide
cactcaagttacatcc

SEQ ID NO: 1664 - DNA, 16 bp, Artificial sequence
  Synthetic oligonucleotide
gggtttttgtcatcag

SEQ ID NO: 1665 - DNA, 16 bp, Artificial sequence
  Synthetic oligonucleotide
aatcaccttttattgc

SEQ ID NO: 1666 - DNA, 16 bp, Artificial sequence
  Synthetic oligonucleotide
cttaaagtgatacacc

SEQ ID NO: 1667 - DNA, 16 bp, Artificial sequence
  Synthetic oligonucleotide
gaaatattggtaagtc

SEQ ID NO: 1668 - DNA, 16 bp, Artificial sequence
  Synthetic oligonucleotide
gattacaaagacagcc

SEQ ID NO: 1669 - DNA, 16 bp, Artificial sequence
  Synthetic oligonucleotide
tataaataccaggtac

SEQ ID NO: 1670 - DNA, 16 bp, Artificial sequence
  Synthetic oligonucleotide
tcccaaaaggagtagc

SEQ ID NO: 1671 - DNA, 16 bp, Artificial sequence
  Synthetic oligonucleotide
gaaattacccgggaac

SEQ ID NO: 1672 - DNA, 16 bp, Artificial sequence
  Synthetic oligonucleotide
catcaacaatggtcta

SEQ ID NO: 1673 - DNA, 16 bp, Artificial sequence
  Synthetic oligonucleotide
gataattactaactga

SEQ ID NO: 1674 - DNA, 16 bp, Artificial sequence
  Synthetic oligonucleotide
aaattatggtcaggct

SEQ ID NO: 1675 - DNA, 16 bp, Artificial sequence
  Synthetic oligonucleotide
aaacgaaacacgggta

SEQ ID NO: 1676 - DNA, 16 bp, Artificial sequence
  Synthetic oligonucleotide
gcttatatcctgtaac

SEQ ID NO: 1677 - DNA, 16 bp, Artificial sequence
  Synthetic oligonucleotide
ggagaataagcaatca

SEQ ID NO: 1678 - DNA, 16 bp, Artificial sequence
  Synthetic oligonucleotide
cgattaaaacactggt

SEQ ID NO: 1679 - DNA, 16 bp, Artificial sequence
  Synthetic oligonucleotide
ttaactaactaaactg

SEQ ID NO: 1680 - DNA, 16 bp, Artificial sequence
  Synthetic oligonucleotide
gatttattgaactgag

SEQ ID NO: 1681 - DNA, 16 bp, Artificial sequence
  Synthetic oligonucleotide
attatataatgcaggc

SEQ ID NO: 1682 - DNA, 16 bp, Artificial sequence
  Synthetic oligonucleotide
aaatcgaagggcaaac

SEQ ID NO: 1683 - DNA, 16 bp, Artificial sequence
  Synthetic oligonucleotide
gtaagtaagggaaccc

SEQ ID NO: 1684 - DNA, 16 bp, Artificial sequence
  Synthetic oligonucleotide
cattagagtatgaact

SEQ ID NO: 1685 - DNA, 16 bp, Artificial sequence
  Synthetic oligonucleotide
aatctataacccttat

SEQ ID NO: 1686 - DNA, 16 bp, Artificial sequence
  Synthetic oligonucleotide
taaaaaacggtttttc

SEQ ID NO: 1687 - DNA, 16 bp, Artificial sequence
  Synthetic oligonucleotide
caactatacaaggcaa

SEQ ID NO: 1688 - DNA, 16 bp, Artificial sequence
  Synthetic oligonucleotide
ttaaataccttctagc

SEQ ID NO: 1689 - DNA, 16 bp, Artificial sequence
  Synthetic oligonucleotide
ctagaaccttttccag

SEQ ID NO: 1690 - DNA, 16 bp, Artificial sequence
  Synthetic oligonucleotide
cattttatagggccat

SEQ ID NO: 1691 - DNA, 16 bp, Artificial sequence
  Synthetic oligonucleotide
cctaaagaagtcttgg

SEQ ID NO: 1692 - DNA, 16 bp, Artificial sequence
  Synthetic oligonucleotide
ctagaacacgctgatg

SEQ ID NO: 1693 - DNA, 16 bp, Artificial sequence
  Synthetic oligonucleotide
gattaactacaccacg

SEQ ID NO: 1694 - DNA, 16 bp, Artificial sequence
  Synthetic oligonucleotide
cccctatactttttga

SEQ ID NO: 1695 - DNA, 16 bp, Artificial sequence
  Synthetic oligonucleotide
gtattaggaacagatc

SEQ ID NO: 1696 - DNA, 16 bp, Artificial sequence
  Synthetic oligonucleotide
gattaaaagtcgggcc

SEQ ID NO: 1697 - DNA, 16 bp, Artificial sequence
  Synthetic oligonucleotide
tagcgaaaataacatt

SEQ ID NO: 1698 - DNA, 16 bp, Artificial sequence
  Synthetic oligonucleotide
gttaaagagtggaaat

SEQ ID NO: 1699 - DNA, 16 bp, Artificial sequence
  Synthetic oligonucleotide
ctttaaggtctagtta

SEQ ID NO: 1700 - DNA, 16 bp, Artificial sequence
  Synthetic oligonucleotide
tacgaaatagtaactg

SEQ ID NO: 1701 - DNA, 16 bp, Artificial sequence
  Synthetic oligonucleotide
caccaacaacctcatg

SEQ ID NO: 1702 - DNA, 16 bp, Artificial sequence
  Synthetic oligonucleotide
ctactatatctttggg

SEQ ID NO: 1703 - DNA, 16 bp, Artificial sequence
  Synthetic oligonucleotide
ctaaaaagacagggcc

SEQ ID NO: 1704 - DNA, 16 bp, Artificial sequence
  Synthetic oligonucleotide
ccaataaagcaagtag

SEQ ID NO: 1705 - DNA, 16 bp, Artificial sequence
  Synthetic oligonucleotide
tattacccaataacca

SEQ ID NO: 1706 - DNA, 16 bp, Artificial sequence
  Synthetic oligonucleotide
ttataaagacccaatg

SEQ ID NO: 1707 - DNA, 16 bp, Artificial sequence
  Synthetic oligonucleotide
aattatactggctact

SEQ ID NO: 1708 - DNA, 16 bp, Artificial sequence
  Synthetic oligonucleotide
tgggaaaagctaccac

SEQ ID NO: 1709 - DNA, 16 bp, Artificial sequence
  Synthetic oligonucleotide
ctttacttactggtgg

SEQ ID NO: 1710 - DNA, 16 bp, Artificial sequence
  Synthetic oligonucleotide
cgggaaaattctggag

SEQ ID NO: 1711 - DNA, 16 bp, Artificial sequence
  Synthetic oligonucleotide
gaactataatcttata

SEQ ID NO: 1712 - DNA, 16 bp, Artificial sequence
  Synthetic oligonucleotide
caaaataggtgagtca

SEQ ID NO: 1713 - DNA, 16 bp, Artificial sequence
  Synthetic oligonucleotide
actaaaggagtcatga

SEQ ID NO: 1714 - DNA, 16 bp, Artificial sequence
  Synthetic oligonucleotide
tgggaataatttggcc

SEQ ID NO: 1715 - DNA, 16 bp, Artificial sequence
  Synthetic oligonucleotide
ctgcgaggcactcgga

SEQ ID NO: 1716 - DNA, 16 bp, Artificial sequence
  Synthetic oligonucleotide
ccacgggccgaggtgg

SEQ ID NO: 1717 - DNA, 16 bp, Artificial sequence
  Synthetic oligonucleotide
gggccggttgaggcgg

SEQ ID NO: 1718 - DNA, 16 bp, Artificial sequence
  Synthetic oligonucleotide
agggctcctgcagtgc

SEQ ID NO: 1719 - DNA, 16 bp, Artificial sequence
  Synthetic oligonucleotide
ctgatcgatgtgattt

SEQ ID NO: 1720 - DNA, 16 bp, Artificial sequence
  Synthetic oligonucleotide
cgagggtcaagccttg

SEQ ID NO: 1721 - DNA, 16 bp, Artificial sequence
  Synthetic oligonucleotide
attgatattccgcatt

SEQ ID NO: 1722 - DNA, 16 bp, Artificial sequence
  Synthetic oligonucleotide
atctgagctattggtc

SEQ ID NO: 1723 - DNA, 16 bp, Artificial sequence
  Synthetic oligonucleotide
gaaacggttctgctgt

SEQ ID NO: 1724 - DNA, 16 bp, Artificial sequence
  Synthetic oligonucleotide
tagaggattaaagtat

SEQ ID NO: 1725 - DNA, 16 bp, Artificial sequence
  Synthetic oligonucleotide
gaccagtaaatcatgt

SEQ ID NO: 1726 - DNA, 16 bp, Artificial sequence
  Synthetic oligonucleotide
ccaacccccccaccga

SEQ ID NO: 1727 - DNA, 16 bp, Artificial sequence
  Synthetic oligonucleotide
taatcgagatttaaat

SEQ ID NO: 1728 - DNA, 16 bp, Artificial sequence
  Synthetic oligonucleotide
atccacagtaatagct

SEQ ID NO: 1729 - DNA, 16 bp, Artificial sequence
  Synthetic oligonucleotide
atgaacctactcactg

SEQ ID NO: 1730 - DNA, 16 bp, Artificial sequence
  Synthetic oligonucleotide
tccagctaactcaaaa

SEQ ID NO: 1731 - DNA, 16 bp, Artificial sequence
  Synthetic oligonucleotide
gctgaggcttttcata

SEQ ID NO: 1732 - DNA, 16 bp, Artificial sequence
  Synthetic oligonucleotide
catatacccaattttg

SEQ ID NO: 1733 - DNA, 16 bp, Artificial sequence
  Synthetic oligonucleotide
tatcaaggtcccccta

SEQ ID NO: 1734 - DNA, 16 bp, Artificial sequence
  Synthetic oligonucleotide
tatcacagtactgcta

SEQ ID NO: 1735 - DNA, 16 bp, Artificial sequence
  Synthetic oligonucleotide
gctacccaatacaacc

SEQ ID NO: 1736 - DNA, 16 bp, Artificial sequence
  Synthetic oligonucleotide
caaatcaatgtgctcc

SEQ ID NO: 1737 - DNA, 16 bp, Artificial sequence
  Synthetic oligonucleotide
aaatccacctgagcac

SEQ ID NO: 1738 - DNA, 16 bp, Artificial sequence
  Synthetic oligonucleotide
aacattggtactatat

SEQ ID NO: 1739 - DNA, 16 bp, Artificial sequence
  Synthetic oligonucleotide
gaagtttagcctgaag

SEQ ID NO: 1740 - DNA, 16 bp, Artificial sequence
  Synthetic oligonucleotide
ctttccactcaagtta

SEQ ID NO: 1741 - DNA, 16 bp, Artificial sequence
  Synthetic oligonucleotide
ccgggtttttgtcatc

SEQ ID NO: 1742 - DNA, 16 bp, Artificial sequence
  Synthetic oligonucleotide
ctactgtaatcacctt

SEQ ID NO: 1743 - DNA, 16 bp, Artificial sequence
  Synthetic oligonucleotide
ccttaaagtgatacac

SEQ ID NO: 1744 - DNA, 16 bp, Artificial sequence
  Synthetic oligonucleotide
acccaacggtcatgtt

SEQ ID NO: 1745 - DNA, 16 bp, Artificial sequence
  Synthetic oligonucleotide
ctttagatacaagagg

SEQ ID NO: 1746 - DNA, 16 bp, Artificial sequence
  Synthetic oligonucleotide
gtataaataccaggta

SEQ ID NO: 1747 - DNA, 16 bp, Artificial sequence
  Synthetic oligonucleotide
gtattaagggattttc

SEQ ID NO: 1748 - DNA, 16 bp, Artificial sequence
  Synthetic oligonucleotide
ctggaagaaattaccc

SEQ ID NO: 1749 - DNA, 16 bp, Artificial sequence
  Synthetic oligonucleotide
gtattttaacctaaac

SEQ ID NO: 1750 - DNA, 16 bp, Artificial sequence
  Synthetic oligonucleotide
cagggataattactaa

SEQ ID NO: 1751 - DNA, 16 bp, Artificial sequence
  Synthetic oligonucleotide
aataatccagcctagg

SEQ ID NO: 1752 - DNA, 16 bp, Artificial sequence
  Synthetic oligonucleotide
taaacgaaacacgggt

SEQ ID NO: 1753 - DNA, 16 bp, Artificial sequence
  Synthetic oligonucleotide
cccaaaaactagctta

SEQ ID NO: 1754 - DNA, 16 bp, Artificial sequence
  Synthetic oligonucleotide
cttacgaatcacatat

SEQ ID NO: 1755 - DNA, 16 bp, Artificial sequence
  Synthetic oligonucleotide
gagcaacacaagcata

SEQ ID NO: 1756 - DNA, 16 bp, Artificial sequence
  Synthetic oligonucleotide
gtaaaagaggtgcatc

SEQ ID NO: 1757 - DNA, 16 bp, Artificial sequence
  Synthetic oligonucleotide
tccaaaaaccatcagt

SEQ ID NO: 1758 - DNA, 16 bp, Artificial sequence
  Synthetic oligonucleotide
cattatataatgcagg

SEQ ID NO: 1759 - DNA, 16 bp, Artificial sequence
  Synthetic oligonucleotide
gaaatcgaagggcaaa

SEQ ID NO: 1760 - DNA, 16 bp, Artificial sequence
  Synthetic oligonucleotide
gtatttatggcaacat

SEQ ID NO: 1761 - DNA, 16 bp, Artificial sequence
  Synthetic oligonucleotide
tgagaatattcctccc

SEQ ID NO: 1762 - DNA, 16 bp, Artificial sequence
  Synthetic oligonucleotide
cattagccaaagctca

SEQ ID NO: 1763 - DNA, 16 bp, Artificial sequence
  Synthetic oligonucleotide
gtaaaaaacggttttt

SEQ ID NO: 1764 - DNA, 16 bp, Artificial sequence
  Synthetic oligonucleotide
cgttaacaactataca

SEQ ID NO: 1765 - DNA, 16 bp, Artificial sequence
  Synthetic oligonucleotide
gttaaataccttctag

SEQ ID NO: 1766 - DNA, 16 bp, Artificial sequence
  Synthetic oligonucleotide
cttaaatggcacagtt

SEQ ID NO: 1767 - DNA, 16 bp, Artificial sequence
  Synthetic oligonucleotide
ctatattgattccaga

SEQ ID NO: 1768 - DNA, 16 bp, Artificial sequence
  Synthetic oligonucleotide
cataacttagaaccat

SEQ ID NO: 1769 - DNA, 16 bp, Artificial sequence
  Synthetic oligonucleotide
ctataggtacttagaa

SEQ ID NO: 1770 - DNA, 16 bp, Artificial sequence
  Synthetic oligonucleotide
gaaaatcctgattaac

SEQ ID NO: 1771 - DNA, 16 bp, Artificial sequence
  Synthetic oligonucleotide
atttaggatgccttta

SEQ ID NO: 1772 - DNA, 16 bp, Artificial sequence
  Synthetic oligonucleotide
gctgaataagtaactt

SEQ ID NO: 1773 - DNA, 16 bp, Artificial sequence
  Synthetic oligonucleotide
agattaaaagtcgggc

SEQ ID NO: 1774 - DNA, 16 bp, Artificial sequence
  Synthetic oligonucleotide
tataaacaatagcgaa

SEQ ID NO: 1775 - DNA, 16 bp, Artificial sequence
  Synthetic oligonucleotide
cttaagcaagagtcca

SEQ ID NO: 1776 - DNA, 16 bp, Artificial sequence
  Synthetic oligonucleotide
ctaattagctttcagc

SEQ ID NO: 1777 - DNA, 16 bp, Artificial sequence
  Synthetic oligonucleotide
ctacgaaatagtaact

SEQ ID NO: 1778 - DNA, 16 bp, Artificial sequence
  Synthetic oligonucleotide
agccaacaatttttgg

SEQ ID NO: 1779 - DNA, 16 bp, Artificial sequence
  Synthetic oligonucleotide
agtaaagagtactgta

SEQ ID NO: 1780 - DNA, 16 bp, Artificial sequence
  Synthetic oligonucleotide
tctaaaaagacagggc

SEQ ID NO: 1781 - DNA, 16 bp, Artificial sequence
  Synthetic oligonucleotide
ccttaatatatccaca

SEQ ID NO: 1782 - DNA, 16 bp, Artificial sequence
  Synthetic oligonucleotide
attattacccaataac

SEQ ID NO: 1783 - DNA, 16 bp, Artificial sequence
  Synthetic oligonucleotide
gttataaagacccaat

SEQ ID NO: 1784 - DNA, 16 bp, Artificial sequence
  Synthetic oligonucleotide
gaattatactggctac

SEQ ID NO: 1785 - DNA, 16 bp, Artificial sequence
  Synthetic oligonucleotide
ccactaaataaagcag

SEQ ID NO: 1786 - DNA, 16 bp, Artificial sequence
  Synthetic oligonucleotide
cctaaattagacttga

SEQ ID NO: 1787 - DNA, 16 bp, Artificial sequence
  Synthetic oligonucleotide
acgggaaaattctgga

SEQ ID NO: 1788 - DNA, 16 bp, Artificial sequence
  Synthetic oligonucleotide
cttaattagcctcagt

SEQ ID NO: 1789 - DNA, 16 bp, Artificial sequence
  Synthetic oligonucleotide
ccaaaataggtgagtc

SEQ ID NO: 1790 - DNA, 16 bp, Artificial sequence
  Synthetic oligonucleotide
gcactaaaggagtcat

SEQ ID NO: 1791 - DNA, 16 bp, Artificial sequence
  Synthetic oligonucleotide
tgggaatagtgaattt

SEQ ID NO: 1792 - DNA, 16 bp, Artificial sequence
  Synthetic oligonucleotide
gctgcgaggcactcgg

SEQ ID NO: 1793 - DNA, 16 bp, Artificial sequence
  Synthetic oligonucleotide
cccggctccacgggcc

SEQ ID NO: 1794 - DNA, 16 bp, Artificial sequence
  Synthetic oligonucleotide
ctgcgaaggcggctgc

SEQ ID NO: 1795 - DNA, 16 bp, Artificial sequence
  Synthetic oligonucleotide
agtcagggctcctgca

SEQ ID NO: 1796 - DNA, 16 bp, Artificial sequence
  Synthetic oligonucleotide
tctgatcgatgtgatt

SEQ ID NO: 1797 - DNA, 16 bp, Artificial sequence
  Synthetic oligonucleotide
aaaacgagggtcaagc

SEQ ID NO: 1798 - DNA, 16 bp, Artificial sequence
  Synthetic oligonucleotide
gattgatattccgcat

SEQ ID NO: 1799 - DNA, 16 bp, Artificial sequence
  Synthetic oligonucleotide
gttaaggaaaggatct

SEQ ID NO: 1800 - DNA, 16 bp, Artificial sequence
  Synthetic oligonucleotide
tgggaaacggttctgc

SEQ ID NO: 1801 - DNA, 16 bp, Artificial sequence
  Synthetic oligonucleotide
tgtgaaagaggtcagc

SEQ ID NO: 1802 - DNA, 16 bp, Artificial sequence
  Synthetic oligonucleotide
tcagaccagtaaatca

SEQ ID NO: 1803 - DNA, 16 bp, Artificial sequence
  Synthetic oligonucleotide
accaacccccccaccg

SEQ ID NO: 1804 - DNA, 16 bp, Artificial sequence
  Synthetic oligonucleotide
ataatcgagatttaaa

SEQ ID NO: 1805 - DNA, 16 bp, Artificial sequence
  Synthetic oligonucleotide
ctatccacagtaatag

SEQ ID NO: 1806 - DNA, 16 bp, Artificial sequence
  Synthetic oligonucleotide
tatgaacctactcact

SEQ ID NO: 1807 - DNA, 16 bp, Artificial sequence
  Synthetic oligonucleotide
ttccagctaactcaaa

SEQ ID NO: 1808 - DNA, 16 bp, Artificial sequence
  Synthetic oligonucleotide
tcccaagctgaggctt

SEQ ID NO: 1809 - DNA, 16 bp, Artificial sequence
  Synthetic oligonucleotide
cccaacaacatgctat

SEQ ID NO: 1810 - DNA, 16 bp, Artificial sequence
  Synthetic oligonucleotide
ctatcaaggtccccct

SEQ ID NO: 1811 - DNA, 16 bp, Artificial sequence
  Synthetic oligonucleotide
caggtatcacagtact

SEQ ID NO: 1812 - DNA, 16 bp, Artificial sequence
  Synthetic oligonucleotide
tgctacccaatacaac

SEQ ID NO: 1813 - DNA, 16 bp, Artificial sequence
  Synthetic oligonucleotide
ccaaatcaatgtgctc

SEQ ID NO: 1814 - DNA, 16 bp, Artificial sequence
  Synthetic oligonucleotide
taaaatccacctgagc

SEQ ID NO: 1815 - DNA, 16 bp, Artificial sequence
  Synthetic oligonucleotide
gtaacattggtactat

SEQ ID NO: 1816 - DNA, 16 bp, Artificial sequence
  Synthetic oligonucleotide
tgaagtttagcctgaa

SEQ ID NO: 1817 - DNA, 16 bp, Artificial sequence
  Synthetic oligonucleotide
gggcggtaactcttct

SEQ ID NO: 1818 - DNA, 16 bp, Artificial sequence
  Synthetic oligonucleotide
cccgggtttttgtcat

SEQ ID NO: 1819 - DNA, 16 bp, Artificial sequence
  Synthetic oligonucleotide
gccgcggctcccgagc

SEQ ID NO: 1820 - DNA, 16 bp, Artificial sequence
  Synthetic oligonucleotide
cattagagtttgatta

SEQ ID NO: 1821 - DNA, 16 bp, Artificial sequence
  Synthetic oligonucleotide
aataaacaacccaacg

SEQ ID NO: 1822 - DNA, 16 bp, Artificial sequence
  Synthetic oligonucleotide
caacaacactcctctt

SEQ ID NO: 1823 - DNA, 16 bp, Artificial sequence
  Synthetic oligonucleotide
gtatagccttattctt

SEQ ID NO: 1824 - DNA, 16 bp, Artificial sequence
  Synthetic oligonucleotide
tataaaccttacagta

SEQ ID NO: 1825 - DNA, 16 bp, Artificial sequence
  Synthetic oligonucleotide
aattagccggtcccag

SEQ ID NO: 1826 - DNA, 16 bp, Artificial sequence
  Synthetic oligonucleotide
aataaagggtcctaac

SEQ ID NO: 1827 - DNA, 16 bp, Artificial sequence
  Synthetic oligonucleotide
cttagtaagaattgtc

SEQ ID NO: 1828 - DNA, 16 bp, Artificial sequence
  Synthetic oligonucleotide
ctagaaaggccatgta

SEQ ID NO: 1829 - DNA, 16 bp, Artificial sequence
  Synthetic oligonucleotide
attaaacgaaacacgg

SEQ ID NO: 1830 - DNA, 16 bp, Artificial sequence
  Synthetic oligonucleotide
acccaaaaactagctt

SEQ ID NO: 1831 - DNA, 16 bp, Artificial sequence
  Synthetic oligonucleotide
ctgcaaaagttcttac

SEQ ID NO: 1832 - DNA, 16 bp, Artificial sequence
  Synthetic oligonucleotide
cttaatcaggtactat

SEQ ID NO: 1833 - DNA, 16 bp, Artificial sequence
  Synthetic oligonucleotide
cttaaacgataaagta

SEQ ID NO: 1834 - DNA, 16 bp, Artificial sequence
  Synthetic oligonucleotide
cattaatgccatccaa

SEQ ID NO: 1835 - DNA, 16 bp, Artificial sequence
  Synthetic oligonucleotide
gctaaaaaatgagtag

SEQ ID NO: 1836 - DNA, 16 bp, Artificial sequence
  Synthetic oligonucleotide
cttaatagtttaacct

SEQ ID NO: 1837 - DNA, 16 bp, Artificial sequence
  Synthetic oligonucleotide
ccatataaccagtttt

SEQ ID NO: 1838 - DNA, 16 bp, Artificial sequence
  Synthetic oligonucleotide
tataatacatctcccc

SEQ ID NO: 1839 - DNA, 16 bp, Artificial sequence
  Synthetic oligonucleotide
ataagatagtcggttc

SEQ ID NO: 1840 - DNA, 16 bp, Artificial sequence
  Synthetic oligonucleotide
aagtaaaaaacggttt

SEQ ID NO: 1841 - DNA, 16 bp, Artificial sequence
  Synthetic oligonucleotide
cgtcaaaattaacaga

SEQ ID NO: 1842 - DNA, 16 bp, Artificial sequence
  Synthetic oligonucleotide
ttatcctatccctggt

SEQ ID NO: 1843 - DNA, 16 bp, Artificial sequence
  Synthetic oligonucleotide
acttaaatggcacagt

SEQ ID NO: 1844 - DNA, 16 bp, Artificial sequence
  Synthetic oligonucleotide
cttaaggattggctat

SEQ ID NO: 1845 - DNA, 16 bp, Artificial sequence
  Synthetic oligonucleotide
gtatatccgttctcat

SEQ ID NO: 1846 - DNA, 16 bp, Artificial sequence
  Synthetic oligonucleotide
gccgaatatgggaaaa

SEQ ID NO: 1847 - DNA, 16 bp, Artificial sequence
  Synthetic oligonucleotide
actaaaaccatttgcc

SEQ ID NO: 1848 - DNA, 16 bp, Artificial sequence
  Synthetic oligonucleotide
aatttaggatgccttt

SEQ ID NO: 1849 - DNA, 16 bp, Artificial sequence
  Synthetic oligonucleotide
ctttataggaatagag

SEQ ID NO: 1850 - DNA, 16 bp, Artificial sequence
  Synthetic oligonucleotide
cataatccactatgca

SEQ ID NO: 1851 - DNA, 16 bp, Artificial sequence
  Synthetic oligonucleotide
atataaacaatagcga

SEQ ID NO: 1852 - DNA, 16 bp, Artificial sequence
  Synthetic oligonucleotide
caaaaaggctattgag

SEQ ID NO: 1853 - DNA, 16 bp, Artificial sequence
  Synthetic oligonucleotide
acacaagggttgctaa

SEQ ID NO: 1854 - DNA, 16 bp, Artificial sequence
  Synthetic oligonucleotide
cattaccaacttcttc

SEQ ID NO: 1855 - DNA, 16 bp, Artificial sequence
  Synthetic oligonucleotide
cgaaaaaagccaacaa

SEQ ID NO: 1856 - DNA, 16 bp, Artificial sequence
  Synthetic oligonucleotide
attagtaaagagtact

SEQ ID NO: 1857 - DNA, 16 bp, Artificial sequence
  Synthetic oligonucleotide
gttaatacatggccaa

SEQ ID NO: 1858 - DNA, 16 bp, Artificial sequence
  Synthetic oligonucleotide
tcaaaataatcagccc

SEQ ID NO: 1859 - DNA, 16 bp, Artificial sequence
  Synthetic oligonucleotide
atttaaggtgcataag

SEQ ID NO: 1860 - DNA, 16 bp, Artificial sequence
  Synthetic oligonucleotide
cgttataaagacccaa

SEQ ID NO: 1861 - DNA, 16 bp, Artificial sequence
  Synthetic oligonucleotide
cattattcagtagttg

SEQ ID NO: 1862 - DNA, 16 bp, Artificial sequence
  Synthetic oligonucleotide
cataaaagtccactaa

SEQ ID NO: 1863 - DNA, 16 bp, Artificial sequence
  Synthetic oligonucleotide
gtaactaacctaagga

SEQ ID NO: 1864 - DNA, 16 bp, Artificial sequence
  Synthetic oligonucleotide
caaatttactgatctc

SEQ ID NO: 1865 - DNA, 16 bp, Artificial sequence
  Synthetic oligonucleotide
cttcaacaagacaggt

SEQ ID NO: 1866 - DNA, 16 bp, Artificial sequence
  Synthetic oligonucleotide
agccaaaataggtgag

SEQ ID NO: 1867 - DNA, 16 bp, Artificial sequence
  Synthetic oligonucleotide
atttatatcaggtcaa

SEQ ID NO: 1868 - DNA, 16 bp, Artificial sequence
  Synthetic oligonucleotide
tgggaatagtacacag

SEQ ID NO: 1869 - DNA, 16 bp, Artificial sequence
  Synthetic oligonucleotide
ggctgcgaggcactcg

SEQ ID NO: 1870 - DNA, 16 bp, Artificial sequence
  Synthetic oligonucleotide
agggctacgcccggac

SEQ ID NO: 1871 - DNA, 16 bp, Artificial sequence
  Synthetic oligonucleotide
gctgcgaaggcggctg

SEQ ID NO: 1872 - DNA, 16 bp, Artificial sequence
  Synthetic oligonucleotide
aatgagctcgaacatg

SEQ ID NO: 1873 - DNA, 16 bp, Artificial sequence
  Synthetic oligonucleotide
ggacagcatggccttc

SEQ ID NO: 1874 - DNA, 16 bp, Artificial sequence
  Synthetic oligonucleotide
caaaacgagggtcaag

SEQ ID NO: 1875 - DNA, 16 bp, Artificial sequence
  Synthetic oligonucleotide
ggattgatattccgca

SEQ ID NO: 1876 - DNA, 16 bp, Artificial sequence
  Synthetic oligonucleotide
gtactctcatctcgag

SEQ ID NO: 1877 - DNA, 16 bp, Artificial sequence
  Synthetic oligonucleotide
gtctgggaaacggttc

SEQ ID NO: 1878 - DNA, 16 bp, Artificial sequence
  Synthetic oligonucleotide
ctgtgaaagaggtcag

SEQ ID NO: 1879 - DNA, 16 bp, Artificial sequence
  Synthetic oligonucleotide
acatttttggcttgtc

SEQ ID NO: 1880 - DNA, 16 bp, Artificial sequence
  Synthetic oligonucleotide
ttccgacaaaaccaac

SEQ ID NO: 1881 - DNA, 16 bp, Artificial sequence
  Synthetic oligonucleotide
gagagagcagataatc

SEQ ID NO: 1882 - DNA, 16 bp, Artificial sequence
  Synthetic oligonucleotide
actatccacagtaata

SEQ ID NO: 1883 - DNA, 16 bp, Artificial sequence
  Synthetic oligonucleotide
ttatgaacctactcac

SEQ ID NO: 1884 - DNA, 16 bp, Artificial sequence
  Synthetic oligonucleotide
ttattaatctgatcac

SEQ ID NO: 1885 - DNA, 16 bp, Artificial sequence
  Synthetic oligonucleotide
atctatcttcccaagc

SEQ ID NO: 1886 - DNA, 16 bp, Artificial sequence
  Synthetic oligonucleotide
tcccaacaacatgcta

SEQ ID NO: 1887 - DNA, 16 bp, Artificial sequence
  Synthetic oligonucleotide
gtaagacaagtcttta

SEQ ID NO: 1888 - DNA, 16 bp, Artificial sequence
  Synthetic oligonucleotide
ccaggtatcacagtac

SEQ ID NO: 1889 - DNA, 16 bp, Artificial sequence
  Synthetic oligonucleotide
atgctacccaatacaa

SEQ ID NO: 1890 - DNA, 16 bp, Artificial sequence
  Synthetic oligonucleotide
ctccaaatcaatgtgc

SEQ ID NO: 1891 - DNA, 16 bp, Artificial sequence
  Synthetic oligonucleotide
ataaaatccacctgag

SEQ ID NO: 1892 - DNA, 16 bp, Artificial sequence
  Synthetic oligonucleotide
aaaggtaacattggta

SEQ ID NO: 1893 - DNA, 16 bp, Artificial sequence
  Synthetic oligonucleotide
ctgaagtttagcctga

SEQ ID NO: 1894 - DNA, 16 bp, Artificial sequence
  Synthetic oligonucleotide
cctgcaaataggagag

SEQ ID NO: 1895 - DNA, 16 bp, Artificial sequence
  Synthetic oligonucleotide
acccgggtttttgtca

SEQ ID NO: 1896 - DNA, 16 bp, Artificial sequence
  Synthetic oligonucleotide
accgcggcggagtgga

SEQ ID NO: 1897 - DNA, 16 bp, Artificial sequence
  Synthetic oligonucleotide
ttaattagcattagag

SEQ ID NO: 1898 - DNA, 16 bp, Artificial sequence
  Synthetic oligonucleotide
atatatacttgatcca

SEQ ID NO: 1899 - DNA, 16 bp, Artificial sequence
  Synthetic oligonucleotide
tgacaacaacactcct

SEQ ID NO: 1900 - DNA, 16 bp, Artificial sequence
  Synthetic oligonucleotide
cttaacatttaatggc

SEQ ID NO: 1901 - DNA, 16 bp, Artificial sequence
  Synthetic oligonucleotide
cggaaaaaacacctag

SEQ ID NO: 1902 - DNA, 16 bp, Artificial sequence
  Synthetic oligonucleotide
tattactacaaccata

SEQ ID NO: 1903 - DNA, 16 bp, Artificial sequence
  Synthetic oligonucleotide
caataaagggtcctaa

SEQ ID NO: 1904 - DNA, 16 bp, Artificial sequence
  Synthetic oligonucleotide
acccaaaaattctgtg

SEQ ID NO: 1905 - DNA, 16 bp, Artificial sequence
  Synthetic oligonucleotide
gaccaatacaatggga

SEQ ID NO: 1906 - DNA, 16 bp, Artificial sequence
  Synthetic oligonucleotide
aattaaacgaaacacg

SEQ ID NO: 1907 - DNA, 16 bp, Artificial sequence
  Synthetic oligonucleotide
cccgaacacccaaaaa

SEQ ID NO: 1908 - DNA, 16 bp, Artificial sequence
  Synthetic oligonucleotide
atatatagacttgaga

SEQ ID NO: 1909 - DNA, 16 bp, Artificial sequence
  Synthetic oligonucleotide
atataacctgaactaa

SEQ ID NO: 1910 - DNA, 16 bp, Artificial sequence
  Synthetic oligonucleotide
ccttaaacgataaagt

SEQ ID NO: 1911 - DNA, 16 bp, Artificial sequence
  Synthetic oligonucleotide
caccaatactgagtat

SEQ ID NO: 1912 - DNA, 16 bp, Artificial sequence
  Synthetic oligonucleotide
taaattaagccaacac

SEQ ID NO: 1913 - DNA, 16 bp, Artificial sequence
  Synthetic oligonucleotide
acttaatagtttaacc

SEQ ID NO: 1914 - DNA, 16 bp, Artificial sequence
  Synthetic oligonucleotide
atataacaggccacca

SEQ ID NO: 1915 - DNA, 16 bp, Artificial sequence
  Synthetic oligonucleotide
atataatacatctccc

SEQ ID NO: 1916 - DNA, 16 bp, Artificial sequence
  Synthetic oligonucleotide
ccgcaaaatattaatt

SEQ ID NO: 1917 - DNA, 16 bp, Artificial sequence
  Synthetic oligonucleotide
caaagtaaaaaacggt

SEQ ID NO: 1918 - DNA, 16 bp, Artificial sequence
  Synthetic oligonucleotide
taagaacaccatagca

SEQ ID NO: 1919 - DNA, 16 bp, Artificial sequence
  Synthetic oligonucleotide
ctatctgtcagttatc

SEQ ID NO: 1920 - DNA, 16 bp, Artificial sequence
  Synthetic oligonucleotide
atttaccctgccactt

SEQ ID NO: 1921 - DNA, 16 bp, Artificial sequence
  Synthetic oligonucleotide
tcttaaggattggcta

SEQ ID NO: 1922 - DNA, 16 bp, Artificial sequence
  Synthetic oligonucleotide
tctgaacgggctgttg

SEQ ID NO: 1923 - DNA, 16 bp, Artificial sequence
  Synthetic oligonucleotide
gataagccgaatatgg

SEQ ID NO: 1924 - DNA, 16 bp, Artificial sequence
  Synthetic oligonucleotide
attagtaatgactaac

SEQ ID NO: 1925 - DNA, 16 bp, Artificial sequence
  Synthetic oligonucleotide
caatttaggatgcctt

SEQ ID NO: 1926 - DNA, 16 bp, Artificial sequence
  Synthetic oligonucleotide
ggactaaagaatacag

SEQ ID NO: 1927 - DNA, 16 bp, Artificial sequence
  Synthetic oligonucleotide
caatatcctacaccat

SEQ ID NO: 1928 - DNA, 16 bp, Artificial sequence
  Synthetic oligonucleotide
aatataaacaatagcg

SEQ ID NO: 1929 - DNA, 16 bp, Artificial sequence
  Synthetic oligonucleotide
atcaaaaaggctattg

SEQ ID NO: 1930 - DNA, 16 bp, Artificial sequence
  Synthetic oligonucleotide
tatcaatactttagtc

SEQ ID NO: 1931 - DNA, 16 bp, Artificial sequence
  Synthetic oligonucleotide
aaacaaaaccggcttt

SEQ ID NO: 1932 - DNA, 16 bp, Artificial sequence
  Synthetic oligonucleotide
acgaaaaaagccaaca

SEQ ID NO: 1933 - DNA, 16 bp, Artificial sequence
  Synthetic oligonucleotide
tattagtaaagagtac

SEQ ID NO: 1934 - DNA, 16 bp, Artificial sequence
  Synthetic oligonucleotide
gataatgaatccttgt

SEQ ID NO: 1935 - DNA, 16 bp, Artificial sequence
  Synthetic oligonucleotide
ggagaaccttatttat

SEQ ID NO: 1936 - DNA, 16 bp, Artificial sequence
  Synthetic oligonucleotide
gtacaataatgcttcc

SEQ ID NO: 1937 - DNA, 16 bp, Artificial sequence
  Synthetic oligonucleotide
aaaaaatggcttcacg

SEQ ID NO: 1938 - DNA, 16 bp, Artificial sequence
  Synthetic oligonucleotide
tataaggaatggcaac

SEQ ID NO: 1939 - DNA, 16 bp, Artificial sequence
  Synthetic oligonucleotide
ccataaaagtccacta

SEQ ID NO: 1940 - DNA, 16 bp, Artificial sequence
  Synthetic oligonucleotide
ctatatttgagccatg

SEQ ID NO: 1941 - DNA, 16 bp, Artificial sequence
  Synthetic oligonucleotide
attaaaaagaagcacg

SEQ ID NO: 1942 - DNA, 16 bp, Artificial sequence
  Synthetic oligonucleotide
taatatagccccttca

SEQ ID NO: 1943 - DNA, 16 bp, Artificial sequence
  Synthetic oligonucleotide
aaaagatacccccagt

SEQ ID NO: 1944 - DNA, 16 bp, Artificial sequence
  Synthetic oligonucleotide
aatttatatcaggtca

SEQ ID NO: 1945 - DNA, 16 bp, Artificial sequence
  Synthetic oligonucleotide
gtataggcagaagcaa

SEQ ID NO: 1946 - DNA, 16 bp, Artificial sequence
  Synthetic oligonucleotide
gcggctgcgcctcggg

SEQ ID NO: 1947 - DNA, 16 bp, Artificial sequence
  Synthetic oligonucleotide
agcgagggctacgccc

SEQ ID NO: 1948 - DNA, 16 bp, Artificial sequence
  Synthetic oligonucleotide
ggctgcgaaggcggct

SEQ ID NO: 1949 - DNA, 16 bp, Artificial sequence
  Synthetic oligonucleotide
gaatgagctcgaacat

SEQ ID NO: 1950 - DNA, 16 bp, Artificial sequence
  Synthetic oligonucleotide
tctgggacagcatggc

SEQ ID NO: 1951 - DNA, 16 bp, Artificial sequence
  Synthetic oligonucleotide
gcaaaacgagggtcaa

SEQ ID NO: 1952 - DNA, 16 bp, Artificial sequence
  Synthetic oligonucleotide
gagaatttgctgtgct

SEQ ID NO: 1953 - DNA, 16 bp, Artificial sequence
  Synthetic oligonucleotide
ctgtactctcatctcg

SEQ ID NO: 1954 - DNA, 16 bp, Artificial sequence
  Synthetic oligonucleotide
agtctgggaaacggtt

SEQ ID NO: 1955 - DNA, 16 bp, Artificial sequence
  Synthetic oligonucleotide
actgtgaaagaggtca

SEQ ID NO: 1956 - DNA, 16 bp, Artificial sequence
  Synthetic oligonucleotide
tgatagcactaggagg

SEQ ID NO: 1957 - DNA, 16 bp, Artificial sequence
  Synthetic oligonucleotide
gttccgacaaaaccaa

SEQ ID NO: 1958 - DNA, 16 bp, Artificial sequence
  Synthetic oligonucleotide
tgttatgtttgggtgt

SEQ ID NO: 1959 - DNA, 16 bp, Artificial sequence
  Synthetic oligonucleotide
cactatccacagtaat

SEQ ID NO: 1960 - DNA, 16 bp, Artificial sequence
  Synthetic oligonucleotide
attatgaacctactca

SEQ ID NO: 1961 - DNA, 16 bp, Artificial sequence
  Synthetic oligonucleotide
tcaactaccaatatac

SEQ ID NO: 1962 - DNA, 16 bp, Artificial sequence
  Synthetic oligonucleotide
aatctatcttcccaag

SEQ ID NO: 1963 - DNA, 16 bp, Artificial sequence
  Synthetic oligonucleotide
atcccaacaacatgct

SEQ ID NO: 1964 - DNA, 16 bp, Artificial sequence
  Synthetic oligonucleotide
gtgtaagacaagtctt

SEQ ID NO: 1965 - DNA, 16 bp, Artificial sequence
  Synthetic oligonucleotide
gccaggtatcacagta

SEQ ID NO: 1966 - DNA, 16 bp, Artificial sequence
  Synthetic oligonucleotide
caatgctacccaatac

SEQ ID NO: 1967 - DNA, 16 bp, Artificial sequence
  Synthetic oligonucleotide
actccaaatcaatgtg

SEQ ID NO: 1968 - DNA, 16 bp, Artificial sequence
  Synthetic oligonucleotide
ggataaaatccacctg

SEQ ID NO: 1969 - DNA, 16 bp, Artificial sequence
  Synthetic oligonucleotide
tgctcttacatctaaa

SEQ ID NO: 1970 - DNA, 16 bp, Artificial sequence
  Synthetic oligonucleotide
gctgaagtttagcctg

SEQ ID NO: 1971 - DNA, 16 bp, Artificial sequence
  Synthetic oligonucleotide
gcctgcaaataggaga

SEQ ID NO: 1972 - DNA, 16 bp, Artificial sequence
  Synthetic oligonucleotide
aacccgggtttttgtc

SEQ ID NO: 1973 - DNA, 16 bp, Artificial sequence
  Synthetic oligonucleotide
gagggaaagcacgccc

SEQ ID NO: 1974 - DNA, 16 bp, Artificial sequence
  Synthetic oligonucleotide
ttacaacctagatttg

SEQ ID NO: 1975 - DNA, 16 bp, Artificial sequence
  Synthetic oligonucleotide
aatatatacttgatcc

SEQ ID NO: 1976 - DNA, 16 bp, Artificial sequence
  Synthetic oligonucleotide
tgcggaaacaagtgta

SEQ ID NO: 1977 - DNA, 16 bp, Artificial sequence
  Synthetic oligonucleotide
cctcaatagcaagaca

SEQ ID NO: 1978 - DNA, 16 bp, Artificial sequence
  Synthetic oligonucleotide
gcggaaaaaacaccta

SEQ ID NO: 1979 - DNA, 16 bp, Artificial sequence
  Synthetic oligonucleotide
ttatattactacaacc

SEQ ID NO: 1980 - DNA, 16 bp, Artificial sequence
  Synthetic oligonucleotide
acaataaagggtccta

SEQ ID NO: 1981 - DNA, 16 bp, Artificial sequence
  Synthetic oligonucleotide
cctaatatgctattgt

SEQ ID NO: 1982 - DNA, 16 bp, Artificial sequence
  Synthetic oligonucleotide
ttataagaactgtggc

SEQ ID NO: 1983 - DNA, 16 bp, Artificial sequence
  Synthetic oligonucleotide
taattaaacgaaacac

SEQ ID NO: 1984 - DNA, 16 bp, Artificial sequence
  Synthetic oligonucleotide
gctgaacaatctcccg

SEQ ID NO: 1985 - DNA, 16 bp, Artificial sequence
  Synthetic oligonucleotide
tatatatagacttgag

SEQ ID NO: 1986 - DNA, 16 bp, Artificial sequence
  Synthetic oligonucleotide
ctatataacctgaact

SEQ ID NO: 1987 - DNA, 16 bp, Artificial sequence
  Synthetic oligonucleotide
tattagtacgagctac

SEQ ID NO: 1988 - DNA, 16 bp, Artificial sequence
  Synthetic oligonucleotide
tgatataatgaccaag

SEQ ID NO: 1989 - DNA, 16 bp, Artificial sequence
  Synthetic oligonucleotide
cataaattaagccaac

SEQ ID NO: 1990 - DNA, 16 bp, Artificial sequence
  Synthetic oligonucleotide
gattactcagctatgt

SEQ ID NO: 1991 - DNA, 16 bp, Artificial sequence
  Synthetic oligonucleotide
tatataacaggccacc

SEQ ID NO: 1992 - DNA, 16 bp, Artificial sequence
  Synthetic oligonucleotide
attaacatttgcccgc

SEQ ID NO: 1993 - DNA, 16 bp, Artificial sequence
  Synthetic oligonucleotide
gccgcaaaatattaat

SEQ ID NO: 1994 - DNA, 16 bp, Artificial sequence
  Synthetic oligonucleotide
gaataggatacaagca

SEQ ID NO: 1995 - DNA, 16 bp, Artificial sequence
  Synthetic oligonucleotide
cattaaaagttgggtt

SEQ ID NO: 1996 - DNA, 16 bp, Artificial sequence
  Synthetic oligonucleotide
atcctatctgtcagtt

SEQ ID NO: 1997 - DNA, 16 bp, Artificial sequence
  Synthetic oligonucleotide
cttaatacattattcc

SEQ ID NO: 1998 - DNA, 16 bp, Artificial sequence
  Synthetic oligonucleotide
aattacaagctaatgc

SEQ ID NO: 1999 - DNA, 16 bp, Artificial sequence
  Synthetic oligonucleotide
cttaacttcccactcg

SEQ ID NO: 2000 - DNA, 16 bp, Artificial sequence
  Synthetic oligonucleotide
gagcgataagctgtat

SEQ ID NO: 2001 - DNA, 16 bp, Artificial sequence
  Synthetic oligonucleotide
cattagtaatgactaa

SEQ ID NO: 2002 - DNA, 16 bp, Artificial sequence
  Synthetic oligonucleotide
agcaaaaagtgatatg

SEQ ID NO: 2003 - DNA, 16 bp, Artificial sequence
  Synthetic oligonucleotide
taggaacaccaaggtt

SEQ ID NO: 2004 - DNA, 16 bp, Artificial sequence
  Synthetic oligonucleotide
aagcaatatcctacac

SEQ ID NO: 2005 - DNA, 16 bp, Artificial sequence
  Synthetic oligonucleotide
gtttaatacctctgac

SEQ ID NO: 2006 - DNA, 16 bp, Artificial sequence
  Synthetic oligonucleotide
gtgcaataaatagttc

SEQ ID NO: 2007 - DNA, 16 bp, Artificial sequence
  Synthetic oligonucleotide
ggattaaagttttcac

SEQ ID NO: 2008 - DNA, 16 bp, Artificial sequence
  Synthetic oligonucleotide
cttaaatgaccaattc

SEQ ID NO: 2009 - DNA, 16 bp, Artificial sequence
  Synthetic oligonucleotide
tacgaaaaaagccaac

SEQ ID NO: 2010 - DNA, 16 bp, Artificial sequence
  Synthetic oligonucleotide
caatatatcctgagat

SEQ ID NO: 2011 - DNA, 16 bp, Artificial sequence
  Synthetic oligonucleotide
tagtataattcatgac

SEQ ID NO: 2012 - DNA, 16 bp, Artificial sequence
  Synthetic oligonucleotide
actaaaggacaaaggt

SEQ ID NO: 2013 - DNA, 16 bp, Artificial sequence
  Synthetic oligonucleotide
gacgaaaaatattctt

SEQ ID NO: 2014 - DNA, 16 bp, Artificial sequence
  Synthetic oligonucleotide
gtataagaccttggga

SEQ ID NO: 2015 - DNA, 16 bp, Artificial sequence
  Synthetic oligonucleotide
ctataaggaatggcaa

SEQ ID NO: 2016 - DNA, 16 bp, Artificial sequence
  Synthetic oligonucleotide
taagaagggccaatgg

SEQ ID NO: 2017 - DNA, 16 bp, Artificial sequence
  Synthetic oligonucleotide
aacctatatttgagcc

SEQ ID NO: 2018 - DNA, 16 bp, Artificial sequence
  Synthetic oligonucleotide
cattacaagcataggc

SEQ ID NO: 2019 - DNA, 16 bp, Artificial sequence
  Synthetic oligonucleotide
gattaatatagcccct

SEQ ID NO: 2020 - DNA, 16 bp, Artificial sequence
  Synthetic oligonucleotide
tgacaataagggacaa

SEQ ID NO: 2021 - DNA, 16 bp, Artificial sequence
  Synthetic oligonucleotide
gaatttatatcaggtc

SEQ ID NO: 2022 - DNA, 16 bp, Artificial sequence
  Synthetic oligonucleotide
aacaaataccaggttc

SEQ ID NO: 2023 - DNA, 16 bp, Artificial sequence
  Synthetic oligonucleotide
ctggcggctgcgcctc

SEQ ID NO: 2024 - DNA, 16 bp, Artificial sequence
  Synthetic oligonucleotide
gagcgagggctacgcc

SEQ ID NO: 2025 - DNA, 16 bp, Artificial sequence
  Synthetic oligonucleotide
cggcgggccctgcccc

SEQ ID NO: 2026 - DNA, 16 bp, Artificial sequence
  Synthetic oligonucleotide
aggaatgagctcgaac

SEQ ID NO: 2027 - DNA, 16 bp, Artificial sequence
  Synthetic oligonucleotide
atctgggacagcatgg

SEQ ID NO: 2028 - DNA, 16 bp, Artificial sequence
  Synthetic oligonucleotide
tgattctctggttcat

SEQ ID NO: 2029 - DNA, 16 bp, Artificial sequence
  Synthetic oligonucleotide
ggagaatttgctgtgc

SEQ ID NO: 2030 - DNA, 16 bp, Artificial sequence
  Synthetic oligonucleotide
tagtccactgtctgta

SEQ ID NO: 2031 - DNA, 16 bp, Artificial sequence
  Synthetic oligonucleotide
aggtagtctgggaaac

SEQ ID NO: 2032 - DNA, 16 bp, Artificial sequence
  Synthetic oligonucleotide
aactgtgaaagaggtc

SEQ ID NO: 2033 - DNA, 16 bp, Artificial sequence
  Synthetic oligonucleotide
atgatagcactaggag

SEQ ID NO: 2034 - DNA, 16 bp, Artificial sequence
  Synthetic oligonucleotide
cctaggttccgacaaa

SEQ ID NO: 2035 - DNA, 16 bp, Artificial sequence
  Synthetic oligonucleotide
atacattccactacca

SEQ ID NO: 2036 - DNA, 16 bp, Artificial sequence
  Synthetic oligonucleotide
aggcactatccacagt

SEQ ID NO: 2037 - DNA, 16 bp, Artificial sequence
  Synthetic oligonucleotide
cattatgaacctactc

SEQ ID NO: 2038 - DNA, 16 bp, Artificial sequence
  Synthetic oligonucleotide
ggtataatcatgatta

SEQ ID NO: 2039 - DNA, 16 bp, Artificial sequence
  Synthetic oligonucleotide
agattttgtaattggg

SEQ ID NO: 2040 - DNA, 16 bp, Artificial sequence
  Synthetic oligonucleotide
aagtagctttgatctt

SEQ ID NO: 2041 - DNA, 16 bp, Artificial sequence
  Synthetic oligonucleotide
ggtgtaagacaagtct

SEQ ID NO: 2042 - DNA, 16 bp, Artificial sequence
  Synthetic oligonucleotide
tgccaggtatcacagt

SEQ ID NO: 2043 - DNA, 16 bp, Artificial sequence
  Synthetic oligonucleotide
atcccaatgctaccca

SEQ ID NO: 2044 - DNA, 16 bp, Artificial sequence
  Synthetic oligonucleotide
gctttggaagatctga

SEQ ID NO: 2045 - DNA, 16 bp, Artificial sequence
  Synthetic oligonucleotide
gaggataaaatccacc

SEQ ID NO: 2046 - DNA, 16 bp, Artificial sequence
  Synthetic oligonucleotide
tatgagcatgctctta

SEQ ID NO: 2047 - DNA, 16 bp, Artificial sequence
  Synthetic oligonucleotide
tgctgaagtttagcct

SEQ ID NO: 2048 - DNA, 16 bp, Artificial sequence
  Synthetic oligonucleotide
caacaggcctgcaaat

SEQ ID NO: 2049 - DNA, 16 bp, Artificial sequence
  Synthetic oligonucleotide
taacccgggtttttgt

SEQ ID NO: 2050 - DNA, 16 bp, Artificial sequence
  Synthetic oligonucleotide
gccgcaaaggaaaggg

SEQ ID NO: 2051 - DNA, 16 bp, Artificial sequence
  Synthetic oligonucleotide
atttacaacctagatt

SEQ ID NO: 2052 - DNA, 16 bp, Artificial sequence
  Synthetic oligonucleotide
caatatatacttgatc

SEQ ID NO: 2053 - DNA, 16 bp, Artificial sequence
  Synthetic oligonucleotide
agttatagactttgta

SEQ ID NO: 2054 - DNA, 16 bp, Artificial sequence
  Synthetic oligonucleotide
ctatttactctgtcac

SEQ ID NO: 2055 - DNA, 16 bp, Artificial sequence
  Synthetic oligonucleotide
agcggaaaaaacacct

SEQ ID NO: 2056 - DNA, 16 bp, Artificial sequence
  Synthetic oligonucleotide
gatattatattactac

SEQ ID NO: 2057 - DNA, 16 bp, Artificial sequence
  Synthetic oligonucleotide
aacaataaagggtcct

SEQ ID NO: 2058 - DNA, 16 bp, Artificial sequence
  Synthetic oligonucleotide
gataactagtaaccgt

SEQ ID NO: 2059 - DNA, 16 bp, Artificial sequence
  Synthetic oligonucleotide
tatactaacattcacg

SEQ ID NO: 2060 - DNA, 16 bp, Artificial sequence
  Synthetic oligonucleotide
gtaattaaacgaaaca

SEQ ID NO: 2061 - DNA, 16 bp, Artificial sequence
  Synthetic oligonucleotide
actaaaagggagtagg

SEQ ID NO: 2062 - DNA, 16 bp, Artificial sequence
  Synthetic oligonucleotide
gaaaatactcctccta

SEQ ID NO: 2063 - DNA, 16 bp, Artificial sequence
  Synthetic oligonucleotide
actatataacctgaac

SEQ ID NO: 2064 - DNA, 16 bp, Artificial sequence
  Synthetic oligonucleotide
catattagagttgagg

SEQ ID NO: 2065 - DNA, 16 bp, Artificial sequence
  Synthetic oligonucleotide
gccaataagttatcaa

SEQ ID NO: 2066 - DNA, 16 bp, Artificial sequence
  Synthetic oligonucleotide
cttaacatgattctag

SEQ ID NO: 2067 - DNA, 16 bp, Artificial sequence
  Synthetic oligonucleotide
acccaaggacagcaca

SEQ ID NO: 2068 - DNA, 16 bp, Artificial sequence
  Synthetic oligonucleotide
atatataacaggccac

SEQ ID NO: 2069 - DNA, 16 bp, Artificial sequence
  Synthetic oligonucleotide
aattaacatttgcccg

SEQ ID NO: 2070 - DNA, 16 bp, Artificial sequence
  Synthetic oligonucleotide
tataaccaaatgccgc

SEQ ID NO: 2071 - DNA, 16 bp, Artificial sequence
  Synthetic oligonucleotide
aagggatacaagtgtt

SEQ ID NO: 2072 - DNA, 16 bp, Artificial sequence
  Synthetic oligonucleotide
acattaaaagttgggt

SEQ ID NO: 2073 - DNA, 16 bp, Artificial sequence
  Synthetic oligonucleotide
agttatcctatctgtc

SEQ ID NO: 2074 - DNA, 16 bp, Artificial sequence
  Synthetic oligonucleotide
gtaatttaatagacta

SEQ ID NO: 2075 - DNA, 16 bp, Artificial sequence
  Synthetic oligonucleotide
tcagaagaactcccat

SEQ ID NO: 2076 - DNA, 16 bp, Artificial sequence
  Synthetic oligonucleotide
cttagtaattgcccat

SEQ ID NO: 2077 - DNA, 16 bp, Artificial sequence
  Synthetic oligonucleotide
cttataatagagctaa

SEQ ID NO: 2078 - DNA, 16 bp, Artificial sequence
  Synthetic oligonucleotide
cataacactgaaggtg

SEQ ID NO: 2079 - DNA, 16 bp, Artificial sequence
  Synthetic oligonucleotide
cttaaactaactgttg

SEQ ID NO: 2080 - DNA, 16 bp, Artificial sequence
  Synthetic oligonucleotide
tgacaataccttccta

SEQ ID NO: 2081 - DNA, 16 bp, Artificial sequence
  Synthetic oligonucleotide
catgaaagcaatatcc

SEQ ID NO: 2082 - DNA, 16 bp, Artificial sequence
  Synthetic oligonucleotide
aatcaacctatgaggt

SEQ ID NO: 2083 - DNA, 16 bp, Artificial sequence
  Synthetic oligonucleotide
cttaaatggtgcaata

SEQ ID NO: 2084 - DNA, 16 bp, Artificial sequence
  Synthetic oligonucleotide
ctttagcctctatacc

SEQ ID NO: 2085 - DNA, 16 bp, Artificial sequence
  Synthetic oligonucleotide
ctttacctaaatgttg

SEQ ID NO: 2086 - DNA, 16 bp, Artificial sequence
  Synthetic oligonucleotide
atacgaaaaaagccaa

SEQ ID NO: 2087 - DNA, 16 bp, Artificial sequence
  Synthetic oligonucleotide
gatatatggtagcata

SEQ ID NO: 2088 - DNA, 16 bp, Artificial sequence
  Synthetic oligonucleotide
caataaacttaccctt

SEQ ID NO: 2089 - DNA, 16 bp, Artificial sequence
  Synthetic oligonucleotide
gatgaatagctaagaa

SEQ ID NO: 2090 - DNA, 16 bp, Artificial sequence
  Synthetic oligonucleotide
taacaatagtagacga

SEQ ID NO: 2091 - DNA, 16 bp, Artificial sequence
  Synthetic oligonucleotide
aataagcctcaccttt

SEQ ID NO: 2092 - DNA, 16 bp, Artificial sequence
  Synthetic oligonucleotide
acctataaggaatggc

SEQ ID NO: 2093 - DNA, 16 bp, Artificial sequence
  Synthetic oligonucleotide
atttacatgagaggag

SEQ ID NO: 2094 - DNA, 16 bp, Artificial sequence
  Synthetic oligonucleotide
cttgaagggctatgga

SEQ ID NO: 2095 - DNA, 16 bp, Artificial sequence
  Synthetic oligonucleotide
cgttataagatgtgct

SEQ ID NO: 2096 - DNA, 16 bp, Artificial sequence
  Synthetic oligonucleotide
tcagaaggatatgcag

SEQ ID NO: 2097 - DNA, 16 bp, Artificial sequence
  Synthetic oligonucleotide
ctaattgaagctggca

SEQ ID NO: 2098 - DNA, 16 bp, Artificial sequence
  Synthetic oligonucleotide
gtagaaagatggctca

SEQ ID NO: 2099 - DNA, 16 bp, Artificial sequence
  Synthetic oligonucleotide
gccaaatatttaactc

SEQ ID NO: 2100 - DNA, 16 bp, Artificial sequence
  Synthetic oligonucleotide
ccactggtctggcggc

SEQ ID NO: 2101 - DNA, 16 bp, Artificial sequence
  Synthetic oligonucleotide
cgagcgagggctacgc

SEQ ID NO: 2102 - DNA, 16 bp, Artificial sequence
  Synthetic oligonucleotide
acggcgggccctgccc

SEQ ID NO: 2103 - DNA, 16 bp, Artificial sequence
  Synthetic oligonucleotide
gaaacagctcccaact

SEQ ID NO: 2104 - DNA, 16 bp, Artificial sequence
  Synthetic oligonucleotide
tcatctgggacagcat

SEQ ID NO: 2105 - DNA, 16 bp, Artificial sequence
  Synthetic oligonucleotide
actgattctctggttc

SEQ ID NO: 2106 - DNA, 16 bp, Artificial sequence
  Synthetic oligonucleotide
gctaactcctgacatt

SEQ ID NO: 2107 - DNA, 16 bp, Artificial sequence
  Synthetic oligonucleotide
atgcttagtccactgt

SEQ ID NO: 2108 - DNA, 16 bp, Artificial sequence
  Synthetic oligonucleotide
tcaaggtagtctggga

SEQ ID NO: 2109 - DNA, 16 bp, Artificial sequence
  Synthetic oligonucleotide
gccaactgtgaaagag

SEQ ID NO: 2110 - DNA, 16 bp, Artificial sequence
  Synthetic oligonucleotide
aatgatagcactagga

SEQ ID NO: 2111 - DNA, 16 bp, Artificial sequence
  Synthetic oligonucleotide
catttgcctaggttcc

SEQ ID NO: 2112 - DNA, 16 bp, Artificial sequence
  Synthetic oligonucleotide
gatacattccactacc

SEQ ID NO: 2113 - DNA, 16 bp, Artificial sequence
  Synthetic oligonucleotide
cctaggcactatccac

SEQ ID NO: 2114 - DNA, 16 bp, Artificial sequence
  Synthetic oligonucleotide
acattatgaacctact

SEQ ID NO: 2115 - DNA, 16 bp, Artificial sequence
  Synthetic oligonucleotide
aaggtataatcatgat

SEQ ID NO: 2116 - DNA, 16 bp, Artificial sequence
  Synthetic oligonucleotide
tagattttgtaattgg

SEQ ID NO: 2117 - DNA, 16 bp, Artificial sequence
  Synthetic oligonucleotide
caagtagctttgatct

SEQ ID NO: 2118 - DNA, 16 bp, Artificial sequence
  Synthetic oligonucleotide
cggtgtaagacaagtc

SEQ ID NO: 2119 - DNA, 16 bp, Artificial sequence
  Synthetic oligonucleotide
gatcaaagcactgtgc

SEQ ID NO: 2120 - DNA, 16 bp, Artificial sequence
  Synthetic oligonucleotide
ttatcccaatgctacc

SEQ ID NO: 2121 - DNA, 16 bp, Artificial sequence
  Synthetic oligonucleotide
tgctttggaagatctg

SEQ ID NO: 2122 - DNA, 16 bp, Artificial sequence
  Synthetic oligonucleotide
cgaggataaaatccac

SEQ ID NO: 2123 - DNA, 16 bp, Artificial sequence
  Synthetic oligonucleotide
atatgagcatgctctt

SEQ ID NO: 2124 - DNA, 16 bp, Artificial sequence
  Synthetic oligonucleotide
tcctatgctgaagttt

SEQ ID NO: 2125 - DNA, 16 bp, Artificial sequence
  Synthetic oligonucleotide
tacaacaggcctgcaa

SEQ ID NO: 2126 - DNA, 16 bp, Artificial sequence
  Synthetic oligonucleotide
ttaacccgggtttttg

SEQ ID NO: 2127 - DNA, 16 bp, Artificial sequence
  Synthetic oligonucleotide
aattatttgactcccc

SEQ ID NO: 2128 - DNA, 16 bp, Artificial sequence
  Synthetic oligonucleotide
gtatttacaacctaga

SEQ ID NO: 2129 - DNA, 16 bp, Artificial sequence
  Synthetic oligonucleotide
ctattaagtgagcttt

SEQ ID NO: 2130 - DNA, 16 bp, Artificial sequence
  Synthetic oligonucleotide
tctcaataagttatag

SEQ ID NO: 2131 - DNA, 16 bp, Artificial sequence
  Synthetic oligonucleotide
agggaatatgttaatc

SEQ ID NO: 2132 - DNA, 16 bp, Artificial sequence
  Synthetic oligonucleotide
tttaaaagtaccagcg

SEQ ID NO: 2133 - DNA, 16 bp, Artificial sequence
  Synthetic oligonucleotide
attactaagacagtgg

SEQ ID NO: 2134 - DNA, 16 bp, Artificial sequence
  Synthetic oligonucleotide
aaacaataaagggtcc

SEQ ID NO: 2135 - DNA, 16 bp, Artificial sequence
  Synthetic oligonucleotide
ctaagataactagtaa

SEQ ID NO: 2136 - DNA, 16 bp, Artificial sequence
  Synthetic oligonucleotide
ctatactaacattcac

SEQ ID NO: 2137 - DNA, 16 bp, Artificial sequence
  Synthetic oligonucleotide
agtaattaaacgaaac

SEQ ID NO: 2138 - DNA, 16 bp, Artificial sequence
  Synthetic oligonucleotide
aactaaaagggagtag

SEQ ID NO: 2139 - DNA, 16 bp, Artificial sequence
  Synthetic oligonucleotide
ctaaatatcaactccc

SEQ ID NO: 2140 - DNA, 16 bp, Artificial sequence
  Synthetic oligonucleotide
gaactatataacctga

SEQ ID NO: 2141 - DNA, 16 bp, Artificial sequence
  Synthetic oligonucleotide
aattagagatatggac

SEQ ID NO: 2142 - DNA, 16 bp, Artificial sequence
  Synthetic oligonucleotide
agccaataagttatca

SEQ ID NO: 2143 - DNA, 16 bp, Artificial sequence
  Synthetic oligonucleotide
gctgaaaaagggctta

SEQ ID NO: 2144 - DNA, 16 bp, Artificial sequence
  Synthetic oligonucleotide
aattacccaaggacag

SEQ ID NO: 2145 - DNA, 16 bp, Artificial sequence
  Synthetic oligonucleotide
gatatataacaggcca

SEQ ID NO: 2146 - DNA, 16 bp, Artificial sequence
  Synthetic oligonucleotide
accctatagctttagg

SEQ ID NO: 2147 - DNA, 16 bp, Artificial sequence
  Synthetic oligonucleotide
ccctataaccaaatgc

SEQ ID NO: 2148 - DNA, 16 bp, Artificial sequence
  Synthetic oligonucleotide
ctaaataggtggttat

SEQ ID NO: 2149 - DNA, 16 bp, Artificial sequence
  Synthetic oligonucleotide
gaataacaccacatta

SEQ ID NO: 2150 - DNA, 16 bp, Artificial sequence
  Synthetic oligonucleotide
ttatcggaggcttcgc

SEQ ID NO: 2151 - DNA, 16 bp, Artificial sequence
  Synthetic oligonucleotide
ccttataaattatgac

SEQ ID NO: 2152 - DNA, 16 bp, Artificial sequence
  Synthetic oligonucleotide
ctttatcagccatcac

SEQ ID NO: 2153 - DNA, 16 bp, Artificial sequence
  Synthetic oligonucleotide
tattagaggttccagg

SEQ ID NO: 2154 - DNA, 16 bp, Artificial sequence
  Synthetic oligonucleotide
gatttttaggcagacg

SEQ ID NO: 2155 - DNA, 16 bp, Artificial sequence
  Synthetic oligonucleotide
tattacttgattgaca

SEQ ID NO: 2156 - DNA, 16 bp, Artificial sequence
  Synthetic oligonucleotide
tcttaaactaactgtt

SEQ ID NO: 2157 - DNA, 16 bp, Artificial sequence
  Synthetic oligonucleotide
cacggaagagcttgca

SEQ ID NO: 2158 - DNA, 16 bp, Artificial sequence
  Synthetic oligonucleotide
atcgaaaagcaaactc

SEQ ID NO: 2159 - DNA, 16 bp, Artificial sequence
  Synthetic oligonucleotide
atttagttggttgtta

SEQ ID NO: 2160 - DNA, 16 bp, Artificial sequence
  Synthetic oligonucleotide
acttaaatggtgcaat

SEQ ID NO: 2161 - DNA, 16 bp, Artificial sequence
  Synthetic oligonucleotide
aagcaatatatggcct

SEQ ID NO: 2162 - DNA, 16 bp, Artificial sequence
  Synthetic oligonucleotide
aattagttaggatatc

SEQ ID NO: 2163 - DNA, 16 bp, Artificial sequence
  Synthetic oligonucleotide
gatacgaaaaaagcca

SEQ ID NO: 2164 - DNA, 16 bp, Artificial sequence
  Synthetic oligonucleotide
caataggtaacaggta

SEQ ID NO: 2165 - DNA, 16 bp, Artificial sequence
  Synthetic oligonucleotide
agtcaataaacttacc

SEQ ID NO: 2166 - DNA, 16 bp, Artificial sequence
  Synthetic oligonucleotide
gtttaaaaaaaacggg

SEQ ID NO: 2167 - DNA, 16 bp, Artificial sequence
  Synthetic oligonucleotide
cggcaacaacaaaatg

SEQ ID NO: 2168 - DNA, 16 bp, Artificial sequence
  Synthetic oligonucleotide
ctaataagcctcacct

SEQ ID NO: 2169 - DNA, 16 bp, Artificial sequence
  Synthetic oligonucleotide
cacctataaggaatgg

SEQ ID NO: 2170 - DNA, 16 bp, Artificial sequence
  Synthetic oligonucleotide
ctatttacatgagagg

SEQ ID NO: 2171 - DNA, 16 bp, Artificial sequence
  Synthetic oligonucleotide
gataacttagagatgt

SEQ ID NO: 2172 - DNA, 16 bp, Artificial sequence
  Synthetic oligonucleotide
caccaatagaacatat

SEQ ID NO: 2173 - DNA, 16 bp, Artificial sequence
  Synthetic oligonucleotide
gattagtaacactgat

SEQ ID NO: 2174 - DNA, 16 bp, Artificial sequence
  Synthetic oligonucleotide
gattagtgaaaattcc

SEQ ID NO: 2175 - DNA, 16 bp, Artificial sequence
  Synthetic oligonucleotide
gcacaaccttacattt

SEQ ID NO: 2176 - DNA, 16 bp, Artificial sequence
  Synthetic oligonucleotide
aacaaatatagttagc

SEQ ID NO: 2177 - DNA, 16 bp, Artificial sequence
  Synthetic oligonucleotide
ctccactggtctggcg

SEQ ID NO: 2178 - DNA, 16 bp, Artificial sequence
  Synthetic oligonucleotide
gcgagcgagggctacg

SEQ ID NO: 2179 - DNA, 16 bp, Artificial sequence
  Synthetic oligonucleotide
gacggcgggccctgcc

SEQ ID NO: 2180 - DNA, 16 bp, Artificial sequence
  Synthetic oligonucleotide
cagagactactccagt

SEQ ID NO: 2181 - DNA, 16 bp, Artificial sequence
  Synthetic oligonucleotide
cactggtggactggtg

SEQ ID NO: 2182 - DNA, 16 bp, Artificial sequence
  Synthetic oligonucleotide
gactgattctctggtt

SEQ ID NO: 2183 - DNA, 16 bp, Artificial sequence
  Synthetic oligonucleotide
ggctaactcctgacat

SEQ ID NO: 2184 - DNA, 16 bp, Artificial sequence
  Synthetic oligonucleotide
catgcttagtccactg

SEQ ID NO: 2185 - DNA, 16 bp, Artificial sequence
  Synthetic oligonucleotide
ttcaaggtagtctggg

SEQ ID NO: 2186 - DNA, 16 bp, Artificial sequence
  Synthetic oligonucleotide
ctttagagccaactgt

SEQ ID NO: 2187 - DNA, 16 bp, Artificial sequence
  Synthetic oligonucleotide
taatgatagcactagg

SEQ ID NO: 2188 - DNA, 16 bp, Artificial sequence
  Synthetic oligonucleotide
tcatttgcctaggttc

SEQ ID NO: 2189 - DNA, 16 bp, Artificial sequence
  Synthetic oligonucleotide
ggatacattccactac

SEQ ID NO: 2190 - DNA, 16 bp, Artificial sequence
  Synthetic oligonucleotide
ctcccctaggcactat

SEQ ID NO: 2191 - DNA, 16 bp, Artificial sequence
  Synthetic oligonucleotide
atgcacattatgaacc

SEQ ID NO: 2192 - DNA, 16 bp, Artificial sequence
  Synthetic oligonucleotide
gttacatcatctcttc

SEQ ID NO: 2193 - DNA, 16 bp, Artificial sequence
  Synthetic oligonucleotide
gccaaaatacttagat

SEQ ID NO: 2194 - DNA, 16 bp, Artificial sequence
  Synthetic oligonucleotide
ccaagtagctttgatc

SEQ ID NO: 2195 - DNA, 16 bp, Artificial sequence
  Synthetic oligonucleotide
cacggtgtaagacaag

SEQ ID NO: 2196 - DNA, 16 bp, Artificial sequence
  Synthetic oligonucleotide
tcagtacagagggcat

SEQ ID NO: 2197 - DNA, 16 bp, Artificial sequence
  Synthetic oligonucleotide
cttatcccaatgctac

SEQ ID NO: 2198 - DNA, 16 bp, Artificial sequence
  Synthetic oligonucleotide
caaatagtgctttgga

SEQ ID NO: 2199 - DNA, 16 bp, Artificial sequence
  Synthetic oligonucleotide
gcgaggataaaatcca

SEQ ID NO: 2200 - DNA, 16 bp, Artificial sequence
  Synthetic oligonucleotide
catatgagcatgctct

SEQ ID NO: 2201 - DNA, 16 bp, Artificial sequence
  Synthetic oligonucleotide
gcaaagttcctatgct

SEQ ID NO: 2202 - DNA, 16 bp, Artificial sequence
  Synthetic oligonucleotide
atacaacaggcctgca

SEQ ID NO: 2203 - DNA, 16 bp, Artificial sequence
  Synthetic oligonucleotide
cttaacccgggttttt

SEQ ID NO: 2204 - DNA, 16 bp, Artificial sequence
  Synthetic oligonucleotide
caattatttgactccc

SEQ ID NO: 2205 - DNA, 16 bp, Artificial sequence
  Synthetic oligonucleotide
actgaacaagtatctt

SEQ ID NO: 2206 - DNA, 16 bp, Artificial sequence
  Synthetic oligonucleotide
ctttattatctcaacc

SEQ ID NO: 2207 - DNA, 16 bp, Artificial sequence
  Synthetic oligonucleotide
atttatagtcaggttc

SEQ ID NO: 2208 - DNA, 16 bp, Artificial sequence
  Synthetic oligonucleotide
aattagcctaccacct

SEQ ID NO: 2209 - DNA, 16 bp, Artificial sequence
  Synthetic oligonucleotide
tataatgggaggatta

SEQ ID NO: 2210 - DNA, 16 bp, Artificial sequence
  Synthetic oligonucleotide
caagaacactggtatt

SEQ ID NO: 2211 - DNA, 16 bp, Artificial sequence
  Synthetic oligonucleotide
tattttacacgaacta

SEQ ID NO: 2212 - DNA, 16 bp, Artificial sequence
  Synthetic oligonucleotide
gtacaaaaagcggtcg

SEQ ID NO: 2213 - DNA, 16 bp, Artificial sequence
  Synthetic oligonucleotide
gaactatactaacatt

SEQ ID NO: 2214 - DNA, 16 bp, Artificial sequence
  Synthetic oligonucleotide
ttaattgaactcaggg

SEQ ID NO: 2215 - DNA, 16 bp, Artificial sequence
  Synthetic oligonucleotide
taactaaaagggagta

SEQ ID NO: 2216 - DNA, 16 bp, Artificial sequence
  Synthetic oligonucleotide
cctaaatatcaactcc

SEQ ID NO: 2217 - DNA, 16 bp, Artificial sequence
  Synthetic oligonucleotide
ctaaaatggcataagg

SEQ ID NO: 2218 - DNA, 16 bp, Artificial sequence
  Synthetic oligonucleotide
aaattattagttgtcg

SEQ ID NO: 2219 - DNA, 16 bp, Artificial sequence
  Synthetic oligonucleotide
gattatagttaaacag

SEQ ID NO: 2220 - DNA, 16 bp, Artificial sequence
  Synthetic oligonucleotide
cttaaatgagagaacc

SEQ ID NO: 2221 - DNA, 16 bp, Artificial sequence
  Synthetic oligonucleotide
ttaattacccaaggac

SEQ ID NO: 2222 - DNA, 16 bp, Artificial sequence
  Synthetic oligonucleotide
ttatttaagttgggag

SEQ ID NO: 2223 - DNA, 16 bp, Artificial sequence
  Synthetic oligonucleotide
cactataatctgaccc

SEQ ID NO: 2224 - DNA, 16 bp, Artificial sequence
  Synthetic oligonucleotide
tccctataaccaaatg

SEQ ID NO: 2225 - DNA, 16 bp, Artificial sequence
  Synthetic oligonucleotide
gctaaataggtggtta

SEQ ID NO: 2226 - DNA, 16 bp, Artificial sequence
  Synthetic oligonucleotide
ttacaaaagttactgc

SEQ ID NO: 2227 - DNA, 16 bp, Artificial sequence
  Synthetic oligonucleotide
ctttatcggaggcttc

SEQ ID NO: 2228 - DNA, 16 bp, Artificial sequence
  Synthetic oligonucleotide
gagaaaaactacggat

SEQ ID NO: 2229 - DNA, 16 bp, Artificial sequence
  Synthetic oligonucleotide
gattagaaagtgcctt

SEQ ID NO: 2230 - DNA, 16 bp, Artificial sequence
  Synthetic oligonucleotide
gtattagaggttccag

SEQ ID NO: 2231 - DNA, 16 bp, Artificial sequence
  Synthetic oligonucleotide
cctaatcaagttctgc

SEQ ID NO: 2232 - DNA, 16 bp, Artificial sequence
  Synthetic oligonucleotide
acttaaacttgaggga

SEQ ID NO: 2233 - DNA, 16 bp, Artificial sequence
  Synthetic oligonucleotide
aaagaaagctgcgcac

SEQ ID NO: 2234 - DNA, 16 bp, Artificial sequence
  Synthetic oligonucleotide
ctatatacctgcttct

SEQ ID NO: 2235 - DNA, 16 bp, Artificial sequence
  Synthetic oligonucleotide
tatcgaaaagcaaact

SEQ ID NO: 2236 - DNA, 16 bp, Artificial sequence
  Synthetic oligonucleotide
taataggatggattct

SEQ ID NO: 2237 - DNA, 16 bp, Artificial sequence
  Synthetic oligonucleotide
gattaaaggctggaag

SEQ ID NO: 2238 - DNA, 16 bp, Artificial sequence
  Synthetic oligonucleotide
cattagcagttcacta

SEQ ID NO: 2239 - DNA, 16 bp, Artificial sequence
  Synthetic oligonucleotide
attcaaaaccacggaa

SEQ ID NO: 2240 - DNA, 16 bp, Artificial sequence
  Synthetic oligonucleotide
ttttatagggcaatgg

SEQ ID NO: 2241 - DNA, 16 bp, Artificial sequence
  Synthetic oligonucleotide
ctccaataggtaacag

SEQ ID NO: 2242 - DNA, 16 bp, Artificial sequence
  Synthetic oligonucleotide
gaggaatattacagac

SEQ ID NO: 2243 - DNA, 16 bp, Artificial sequence
  Synthetic oligonucleotide
attaaaagcaaggtgc

SEQ ID NO: 2244 - DNA, 16 bp, Artificial sequence
  Synthetic oligonucleotide
ttagaacaactactac

SEQ ID NO: 2245 - DNA, 16 bp, Artificial sequence
  Synthetic oligonucleotide
actaataagcctcacc

SEQ ID NO: 2246 - DNA, 16 bp, Artificial sequence
  Synthetic oligonucleotide
cattaccacctataag

SEQ ID NO: 2247 - DNA, 16 bp, Artificial sequence
  Synthetic oligonucleotide
cattttatgtaaggcc

SEQ ID NO: 2248 - DNA, 16 bp, Artificial sequence
  Synthetic oligonucleotide
gttaaaagccgtgaaa

SEQ ID NO: 2249 - DNA, 16 bp, Artificial sequence
  Synthetic oligonucleotide
cattagtattcactgt

SEQ ID NO: 2250 - DNA, 16 bp, Artificial sequence
  Synthetic oligonucleotide
catatacaattctgcc

SEQ ID NO: 2251 - DNA, 16 bp, Artificial sequence
  Synthetic oligonucleotide
gttaaagaccaacaca

SEQ ID NO: 2252 - DNA, 16 bp, Artificial sequence
  Synthetic oligonucleotide
ttataatgggaggatt

SEQ ID NO: 2253 - DNA, 16 bp, Artificial sequence
  Synthetic oligonucleotide
tccaaatatggcatac

SEQ ID NO: 2254 - DNA, 16 bp, Artificial sequence
  Synthetic oligonucleotide
cccggctccactggtc

SEQ ID NO: 2255 - DNA, 16 bp, Artificial sequence
  Synthetic oligonucleotide
ggcgagcgagggctac

SEQ ID NO: 2256 - DNA, 16 bp, Artificial sequence
  Synthetic oligonucleotide
ggtccggacggcgggc

SEQ ID NO: 2257 - DNA, 16 bp, Artificial sequence
  Synthetic oligonucleotide
ccagagactactccag

SEQ ID NO: 2258 - DNA, 16 bp, Artificial sequence
  Synthetic oligonucleotide
gcactggtggactggt

SEQ ID NO: 2259 - DNA, 16 bp, Artificial sequence
  Synthetic oligonucleotide
tgactgattctctggt

SEQ ID NO: 2260 - DNA, 16 bp, Artificial sequence
  Synthetic oligonucleotide
gggctaactcctgaca

SEQ ID NO: 2261 - DNA, 16 bp, Artificial sequence
  Synthetic oligonucleotide
gacactgtagctgctc

SEQ ID NO: 2262 - DNA, 16 bp, Artificial sequence
  Synthetic oligonucleotide
cttcaaggtagtctgg

SEQ ID NO: 2263 - DNA, 16 bp, Artificial sequence
  Synthetic oligonucleotide
tctttagagccaactg

SEQ ID NO: 2264 - DNA, 16 bp, Artificial sequence
  Synthetic oligonucleotide
ctaatgatagcactag

SEQ ID NO: 2265 - DNA, 16 bp, Artificial sequence
  Synthetic oligonucleotide
aatatggtcatttgcc

SEQ ID NO: 2266 - DNA, 16 bp, Artificial sequence
  Synthetic oligonucleotide
aggatacattccacta

SEQ ID NO: 2267 - DNA, 16 bp, Artificial sequence
  Synthetic oligonucleotide
actcccctaggcacta

SEQ ID NO: 2268 - DNA, 16 bp, Artificial sequence
  Synthetic oligonucleotide
tatttctgtcatgcac

SEQ ID NO: 2269 - DNA, 16 bp, Artificial sequence
  Synthetic oligonucleotide
ctagttacatcatctc

SEQ ID NO: 2270 - DNA, 16 bp, Artificial sequence
  Synthetic oligonucleotide
ggccaaaatacttaga

SEQ ID NO: 2271 - DNA, 16 bp, Artificial sequence
  Synthetic oligonucleotide
aggcactccttccaag

SEQ ID NO: 2272 - DNA, 16 bp, Artificial sequence
  Synthetic oligonucleotide
gcacggtgtaagacaa

SEQ ID NO: 2273 - DNA, 16 bp, Artificial sequence
  Synthetic oligonucleotide
ttcaggtcagtacaga

SEQ ID NO: 2274 - DNA, 16 bp, Artificial sequence
  Synthetic oligonucleotide
tcttatcccaatgcta

SEQ ID NO: 2275 - DNA, 16 bp, Artificial sequence
  Synthetic oligonucleotide
acaaatagtgctttgg

SEQ ID NO: 2276 - DNA, 16 bp, Artificial sequence
  Synthetic oligonucleotide
tgcgaggataaaatcc

SEQ ID NO: 2277 - DNA, 16 bp, Artificial sequence
  Synthetic oligonucleotide
acatatgagcatgctc

SEQ ID NO: 2278 - DNA, 16 bp, Artificial sequence
  Synthetic oligonucleotide
ggcaaagttcctatgc

SEQ ID NO: 2279 - DNA, 16 bp, Artificial sequence
  Synthetic oligonucleotide
tatacaacaggcctgc

SEQ ID NO: 2280 - DNA, 16 bp, Artificial sequence
  Synthetic oligonucleotide
tcctccttaacccggg

SEQ ID NO: 2281 - DNA, 16 bp, Artificial sequence
  Synthetic oligonucleotide
tctaatcaacactgga

SEQ ID NO: 2282 - DNA, 16 bp, Artificial sequence
  Synthetic oligonucleotide
acttaagaactcacac

SEQ ID NO: 2283 - DNA, 16 bp, Artificial sequence
  Synthetic oligonucleotide
ccttaggagtagactg

SEQ ID NO: 2284 - DNA, 16 bp, Artificial sequence
  Synthetic oligonucleotide
catttatagtcaggtt

SEQ ID NO: 2285 - DNA, 16 bp, Artificial sequence
  Synthetic oligonucleotide
aaaattagcctaccac

SEQ ID NO: 2286 - DNA, 16 bp, Artificial sequence
  Synthetic oligonucleotide
attataatgggaggat

SEQ ID NO: 2287 - DNA, 16 bp, Artificial sequence
  Synthetic oligonucleotide
gcccaagaacactggt

SEQ ID NO: 2288 - DNA, 16 bp, Artificial sequence
  Synthetic oligonucleotide
ttattttacacgaact

SEQ ID NO: 2289 - DNA, 16 bp, Artificial sequence
  Synthetic oligonucleotide
attacgattagatcag

SEQ ID NO: 2290 - DNA, 16 bp, Artificial sequence
  Synthetic oligonucleotide
cagcaaaagtaccatg

SEQ ID NO: 2291 - DNA, 16 bp, Artificial sequence
  Synthetic oligonucleotide
cttaattgaactcagg

SEQ ID NO: 2292 - DNA, 16 bp, Artificial sequence
  Synthetic oligonucleotide
gtaactaaaagggagt

SEQ ID NO: 2293 - DNA, 16 bp, Artificial sequence
  Synthetic oligonucleotide
ctagaaaggttggccc

SEQ ID NO: 2294 - DNA, 16 bp, Artificial sequence
  Synthetic oligonucleotide
ctttaaatagcagagg

SEQ ID NO: 2295 - DNA, 16 bp, Artificial sequence
  Synthetic oligonucleotide
gaattaaagcagtgcc

SEQ ID NO: 2296 - DNA, 16 bp, Artificial sequence
  Synthetic oligonucleotide
agttataactgtacta

SEQ ID NO: 2297 - DNA, 16 bp, Artificial sequence
  Synthetic oligonucleotide
gctaaattacagaggt

SEQ ID NO: 2298 - DNA, 16 bp, Artificial sequence
  Synthetic oligonucleotide
ctttaattacccaagg

SEQ ID NO: 2299 - DNA, 16 bp, Artificial sequence
  Synthetic oligonucleotide
gtagaaaggcattaga

SEQ ID NO: 2300 - DNA, 16 bp, Artificial sequence
  Synthetic oligonucleotide
acactataatctgacc

SEQ ID NO: 2301 - DNA, 16 bp, Artificial sequence
  Synthetic oligonucleotide
ctatattggctcctag

SEQ ID NO: 2302 - DNA, 16 bp, Artificial sequence
  Synthetic oligonucleotide
atttagttgtgcacag

SEQ ID NO: 2303 - DNA, 16 bp, Artificial sequence
  Synthetic oligonucleotide
aataatccatgcttgc

SEQ ID NO: 2304 - DNA, 16 bp, Artificial sequence
  Synthetic oligonucleotide
tatttaaaaatagcgc

SEQ ID NO: 2305 - DNA, 16 bp, Artificial sequence
  Synthetic oligonucleotide
ggagaaaaactacgga

SEQ ID NO: 2306 - DNA, 16 bp, Artificial sequence
  Synthetic oligonucleotide
cattagttgccctgac

SEQ ID NO: 2307 - DNA, 16 bp, Artificial sequence
  Synthetic oligonucleotide
cccctaaagaagattt

SEQ ID NO: 2308 - DNA, 16 bp, Artificial sequence
  Synthetic oligonucleotide
cttaaacaatccctaa

SEQ ID NO: 2309 - DNA, 16 bp, Artificial sequence
  Synthetic oligonucleotide
attaaaagtaggccct

SEQ ID NO: 2310 - DNA, 16 bp, Artificial sequence
  Synthetic oligonucleotide
gaaagaaagctgcgca

SEQ ID NO: 2311 - DNA, 16 bp, Artificial sequence
  Synthetic oligonucleotide
aacctatatacctgct

SEQ ID NO: 2312 - DNA, 16 bp, Artificial sequence
  Synthetic oligonucleotide
atatcgaaaagcaaac

SEQ ID NO: 2313 - DNA, 16 bp, Artificial sequence
  Synthetic oligonucleotide
ctaataggatggattc

SEQ ID NO: 2314 - DNA, 16 bp, Artificial sequence
  Synthetic oligonucleotide
agattaaaggctggaa

SEQ ID NO: 2315 - DNA, 16 bp, Artificial sequence
  Synthetic oligonucleotide
gataattcacccttgt

SEQ ID NO: 2316 - DNA, 16 bp, Artificial sequence
  Synthetic oligonucleotide
tgacaatagccaatgc

SEQ ID NO: 2317 - DNA, 16 bp, Artificial sequence
  Synthetic oligonucleotide
ccttataggttatagt

SEQ ID NO: 2318 - DNA, 16 bp, Artificial sequence
  Synthetic oligonucleotide
ctttatttcccacccg

SEQ ID NO: 2319 - DNA, 16 bp, Artificial sequence
  Synthetic oligonucleotide
cattagcacacctttt

SEQ ID NO: 2320 - DNA, 16 bp, Artificial sequence
  Synthetic oligonucleotide
caataaggaacagttt

SEQ ID NO: 2321 - DNA, 16 bp, Artificial sequence
  Synthetic oligonucleotide
aaacaaaatggcgaat

SEQ ID NO: 2322 - DNA, 16 bp, Artificial sequence
  Synthetic oligonucleotide
tactaataagcctcac

SEQ ID NO: 2323 - DNA, 16 bp, Artificial sequence
  Synthetic oligonucleotide
attaaaccagggactg

SEQ ID NO: 2324 - DNA, 16 bp, Artificial sequence
  Synthetic oligonucleotide
tattcggtattttcta

SEQ ID NO: 2325 - DNA, 16 bp, Artificial sequence
  Synthetic oligonucleotide
tctaaagactctcatt

SEQ ID NO: 2326 - DNA, 16 bp, Artificial sequence
  Synthetic oligonucleotide
attaactttcgctaaa

SEQ ID NO: 2327 - DNA, 16 bp, Artificial sequence
  Synthetic oligonucleotide
gcttaaggaatataca

SEQ ID NO: 2328 - DNA, 16 bp, Artificial sequence
  Synthetic oligonucleotide
aaagaataccaacctg

SEQ ID NO: 2329 - DNA, 16 bp, Artificial sequence
  Synthetic oligonucleotide
ctataatgaggattac

SEQ ID NO: 2330 - DNA, 16 bp, Artificial sequence
  Synthetic oligonucleotide
gtataccaagctactc

SEQ ID NO: 2331 - DNA, 16 bp, Artificial sequence
  Synthetic oligonucleotide
atcccccgccccggcg

SEQ ID NO: 2332 - DNA, 16 bp, Artificial sequence
  Synthetic oligonucleotide
aggcgagcgagggcta

SEQ ID NO: 2333 - DNA, 16 bp, Artificial sequence
  Synthetic oligonucleotide
ccgggtccggacggcg

SEQ ID NO: 2334 - DNA, 16 bp, Artificial sequence
  Synthetic oligonucleotide
ctgtcgaagatgctga

SEQ ID NO: 2335 - DNA, 16 bp, Artificial sequence
  Synthetic oligonucleotide
atattctgctgcactg

SEQ ID NO: 2336 - DNA, 16 bp, Artificial sequence
  Synthetic oligonucleotide
ctgactgattctctgg

SEQ ID NO: 2337 - DNA, 16 bp, Artificial sequence
  Synthetic oligonucleotide
agggctaactcctgac

SEQ ID NO: 2338 - DNA, 16 bp, Artificial sequence
  Synthetic oligonucleotide
ggacactgtagctgct

SEQ ID NO: 2339 - DNA, 16 bp, Artificial sequence
  Synthetic oligonucleotide
caggaatggcttcaag

SEQ ID NO: 2340 - DNA, 16 bp, Artificial sequence
  Synthetic oligonucleotide
ttctttagagccaact

SEQ ID NO: 2341 - DNA, 16 bp, Artificial sequence
  Synthetic oligonucleotide
actaatgatagcacta

SEQ ID NO: 2342 - DNA, 16 bp, Artificial sequence
  Synthetic oligonucleotide
taatatggtcatttgc

SEQ ID NO: 2343 - DNA, 16 bp, Artificial sequence
  Synthetic oligonucleotide
aaggatacattccact

SEQ ID NO: 2344 - DNA, 16 bp, Artificial sequence
  Synthetic oligonucleotide
cactcccctaggcact

SEQ ID NO: 2345 - DNA, 16 bp, Artificial sequence
  Synthetic oligonucleotide
gcttatttctgtcatg

SEQ ID NO: 2346 - DNA, 16 bp, Artificial sequence
  Synthetic oligonucleotide
tctagttacatcatct

SEQ ID NO: 2347 - DNA, 16 bp, Artificial sequence
  Synthetic oligonucleotide
gggccaaaatacttag

SEQ ID NO: 2348 - DNA, 16 bp, Artificial sequence
  Synthetic oligonucleotide
tataggcactccttcc

SEQ ID NO: 2349 - DNA, 16 bp, Artificial sequence
  Synthetic oligonucleotide
ttaatggcagcacggt

SEQ ID NO: 2350 - DNA, 16 bp, Artificial sequence
  Synthetic oligonucleotide
cttcaggtcagtacag

SEQ ID NO: 2351 - DNA, 16 bp, Artificial sequence
  Synthetic oligonucleotide
atcttatcccaatgct

SEQ ID NO: 2352 - DNA, 16 bp, Artificial sequence
  Synthetic oligonucleotide
ggcactacatttagaa

SEQ ID NO: 2353 - DNA, 16 bp, Artificial sequence
  Synthetic oligonucleotide
ttgcgaggataaaatc

SEQ ID NO: 2354 - DNA, 16 bp, Artificial sequence
  Synthetic oligonucleotide
aacatatgagcatgct

SEQ ID NO: 2355 - DNA, 16 bp, Artificial sequence
  Synthetic oligonucleotide
aacttttgggcaaagt

SEQ ID NO: 2356 - DNA, 16 bp, Artificial sequence
  Synthetic oligonucleotide
ctatacaacaggcctg

SEQ ID NO: 2357 - DNA, 16 bp, Artificial sequence
  Synthetic oligonucleotide
aggcaagcagctaaat

SEQ ID NO: 2358 - DNA, 16 bp, Artificial sequence
  Synthetic oligonucleotide
aaactaaatggaccgg

SEQ ID NO: 2359 - DNA, 16 bp, Artificial sequence
  Synthetic oligonucleotide
cttaaaagccatctac

SEQ ID NO: 2360 - DNA, 16 bp, Artificial sequence
  Synthetic oligonucleotide
attacaaagtagcaac

SEQ ID NO: 2361 - DNA, 16 bp, Artificial sequence
  Synthetic oligonucleotide
gcttataatctttcag

SEQ ID NO: 2362 - DNA, 16 bp, Artificial sequence
  Synthetic oligonucleotide
gaaaattagcctacca

SEQ ID NO: 2363 - DNA, 16 bp, Artificial sequence
  Synthetic oligonucleotide
cattataatgggagga

SEQ ID NO: 2364 - DNA, 16 bp, Artificial sequence
  Synthetic oligonucleotide
aaatcgattattcaga

SEQ ID NO: 2365 - DNA, 16 bp, Artificial sequence
  Synthetic oligonucleotide
cttaacactggtaaga

SEQ ID NO: 2366 - DNA, 16 bp, Artificial sequence
  Synthetic oligonucleotide
aattacgattagatca

SEQ ID NO: 2367 - DNA, 16 bp, Artificial sequence
  Synthetic oligonucleotide
gaaaaatgagcccggt

SEQ ID NO: 2368 - DNA, 16 bp, Artificial sequence
  Synthetic oligonucleotide
aataaagtctaatcca

SEQ ID NO: 2369 - DNA, 16 bp, Artificial sequence
  Synthetic oligonucleotide
gtaagtaaaactgctg

SEQ ID NO: 2370 - DNA, 16 bp, Artificial sequence
  Synthetic oligonucleotide
aaaactaatcatcgat

SEQ ID NO: 2371 - DNA, 16 bp, Artificial sequence
  Synthetic oligonucleotide
gattaacagcccttta

SEQ ID NO: 2372 - DNA, 16 bp, Artificial sequence
  Synthetic oligonucleotide
tattagttctacgatt

SEQ ID NO: 2373 - DNA, 16 bp, Artificial sequence
  Synthetic oligonucleotide
tttaataggctctatc

SEQ ID NO: 2374 - DNA, 16 bp, Artificial sequence
  Synthetic oligonucleotide
cataaaggtgacagcc

SEQ ID NO: 2375 - DNA, 16 bp, Artificial sequence
  Synthetic oligonucleotide
gaattggaacacctca

SEQ ID NO: 2376 - DNA, 16 bp, Artificial sequence
  Synthetic oligonucleotide
gatactaagcacagag

SEQ ID NO: 2377 - DNA, 16 bp, Artificial sequence
  Synthetic oligonucleotide
tattataagtctacaa

SEQ ID NO: 2378 - DNA, 16 bp, Artificial sequence
  Synthetic oligonucleotide
agactatattggctcc

SEQ ID NO: 2379 - DNA, 16 bp, Artificial sequence
  Synthetic oligonucleotide
aaatttagttgtgcac

SEQ ID NO: 2380 - DNA, 16 bp, Artificial sequence
  Synthetic oligonucleotide
gtttaataatccatgc

SEQ ID NO: 2381 - DNA, 16 bp, Artificial sequence
  Synthetic oligonucleotide
gtatttaaaaatagcg

SEQ ID NO: 2382 - DNA, 16 bp, Artificial sequence
  Synthetic oligonucleotide
gataaatgggttgatt

SEQ ID NO: 2383 - DNA, 16 bp, Artificial sequence
  Synthetic oligonucleotide
cataatgaatgtgggt

SEQ ID NO: 2384 - DNA, 16 bp, Artificial sequence
  Synthetic oligonucleotide
tagggaaaaccatagc

SEQ ID NO: 2385 - DNA, 16 bp, Artificial sequence
  Synthetic oligonucleotide
ccttaaacaatcccta

SEQ ID NO: 2386 - DNA, 16 bp, Artificial sequence
  Synthetic oligonucleotide
gattaaaagtaggccc

SEQ ID NO: 2387 - DNA, 16 bp, Artificial sequence
  Synthetic oligonucleotide
gcccaaaataggatac

SEQ ID NO: 2388 - DNA, 16 bp, Artificial sequence
  Synthetic oligonucleotide
atttaaggctgtgttc

SEQ ID NO: 2389 - DNA, 16 bp, Artificial sequence
  Synthetic oligonucleotide
gaatatcgaaaagcaa

SEQ ID NO: 2390 - DNA, 16 bp, Artificial sequence
  Synthetic oligonucleotide
actaataggatggatt

SEQ ID NO: 2391 - DNA, 16 bp, Artificial sequence
  Synthetic oligonucleotide
ctttagattaaaggct

SEQ ID NO: 2392 - DNA, 16 bp, Artificial sequence
  Synthetic oligonucleotide
tctcaatacactatat

SEQ ID NO: 2393 - DNA, 16 bp, Artificial sequence
  Synthetic oligonucleotide
attagtaagctgagga

SEQ ID NO: 2394 - DNA, 16 bp, Artificial sequence
  Synthetic oligonucleotide
gctaaaactttcatcc

SEQ ID NO: 2395 - DNA, 16 bp, Artificial sequence
  Synthetic oligonucleotide
cctgaaatacaggtgt

SEQ ID NO: 2396 - DNA, 16 bp, Artificial sequence
  Synthetic oligonucleotide
atttatatgctccctc

SEQ ID NO: 2397 - DNA, 16 bp, Artificial sequence
  Synthetic oligonucleotide
atgcaataaggaacag

SEQ ID NO: 2398 - DNA, 16 bp, Artificial sequence
  Synthetic oligonucleotide
tgagaatagagcaggt

SEQ ID NO: 2399 - DNA, 16 bp, Artificial sequence
  Synthetic oligonucleotide
ctttactactaataag

SEQ ID NO: 2400 - DNA, 16 bp, Artificial sequence
  Synthetic oligonucleotide
cattaaaccagggact

SEQ ID NO: 2401 - DNA, 16 bp, Artificial sequence
  Synthetic oligonucleotide
gattattcggtatttt

SEQ ID NO: 2402 - DNA, 16 bp, Artificial sequence
  Synthetic oligonucleotide
cgtaattatttttgct

SEQ ID NO: 2403 - DNA, 16 bp, Artificial sequence
  Synthetic oligonucleotide
ctttaggtttatgcct

SEQ ID NO: 2404 - DNA, 16 bp, Artificial sequence
  Synthetic oligonucleotide
atttagagcttaagga

SEQ ID NO: 2405 - DNA, 16 bp, Artificial sequence
  Synthetic oligonucleotide
ttacaataccttatga

SEQ ID NO: 2406 - DNA, 16 bp, Artificial sequence
  Synthetic oligonucleotide
agtataaagcagggca

SEQ ID NO: 2407 - DNA, 16 bp, Artificial sequence
  Synthetic oligonucleotide
tattacagagggtagc

SEQ ID NO: 2408 - DNA, 16 bp, Artificial sequence
  Synthetic oligonucleotide
ggccccgcatcccccg

SEQ ID NO: 2409 - DNA, 16 bp, Artificial sequence
  Synthetic oligonucleotide
caggcgagcgagggct

SEQ ID NO: 2410 - DNA, 16 bp, Artificial sequence
  Synthetic oligonucleotide
cccgggtccggacggc

SEQ ID NO: 2411 - DNA, 16 bp, Artificial sequence
  Synthetic oligonucleotide
actgtcgaagatgctg

SEQ ID NO: 2412 - DNA, 16 bp, Artificial sequence
  Synthetic oligonucleotide
tcatattctgctgcac

SEQ ID NO: 2413 - DNA, 16 bp, Artificial sequence
  Synthetic oligonucleotide
cactctgactgattct

SEQ ID NO: 2414 - DNA, 16 bp, Artificial sequence
  Synthetic oligonucleotide
cagggctaactcctga

SEQ ID NO: 2415 - DNA, 16 bp, Artificial sequence
  Synthetic oligonucleotide
agggacactgtagctg

SEQ ID NO: 2416 - DNA, 16 bp, Artificial sequence
  Synthetic oligonucleotide
ccaggaatggcttcaa

SEQ ID NO: 2417 - DNA, 16 bp, Artificial sequence
  Synthetic oligonucleotide
attctttagagccaac

SEQ ID NO: 2418 - DNA, 16 bp, Artificial sequence
  Synthetic oligonucleotide
gactaatgatagcact

SEQ ID NO: 2419 - DNA, 16 bp, Artificial sequence
  Synthetic oligonucleotide
cactaatatggtcatt

SEQ ID NO: 2420 - DNA, 16 bp, Artificial sequence
  Synthetic oligonucleotide
taactggaaagcaggg

SEQ ID NO: 2421 - DNA, 16 bp, Artificial sequence
  Synthetic oligonucleotide
gagcactcccctaggc

SEQ ID NO: 2422 - DNA, 16 bp, Artificial sequence
  Synthetic oligonucleotide
ccactataaagcttat

SEQ ID NO: 2423 - DNA, 16 bp, Artificial sequence
  Synthetic oligonucleotide
tagcttatattgaaga

SEQ ID NO: 2424 - DNA, 16 bp, Artificial sequence
  Synthetic oligonucleotide
ttgaagggccaaaata

SEQ ID NO: 2425 - DNA, 16 bp, Artificial sequence
  Synthetic oligonucleotide
aaattataggcactcc

SEQ ID NO: 2426 - DNA, 16 bp, Artificial sequence
  Synthetic oligonucleotide
tttaatggcagcacgg

SEQ ID NO: 2427 - DNA, 16 bp, Artificial sequence
  Synthetic oligonucleotide
gactcttaggtctcct

SEQ ID NO: 2428 - DNA, 16 bp, Artificial sequence
  Synthetic oligonucleotide
aatcttatcccaatgc

SEQ ID NO: 2429 - DNA, 16 bp, Artificial sequence
  Synthetic oligonucleotide
aggcactacatttaga

SEQ ID NO: 2430 - DNA, 16 bp, Artificial sequence
  Synthetic oligonucleotide
cttgcgaggataaaat

SEQ ID NO: 2431 - DNA, 16 bp, Artificial sequence
  Synthetic oligonucleotide
taacatatgagcatgc

SEQ ID NO: 2432 - DNA, 16 bp, Artificial sequence
  Synthetic oligonucleotide
taacttttgggcaaag

SEQ ID NO: 2433 - DNA, 16 bp, Artificial sequence
  Synthetic oligonucleotide
gagactatacaacagg

SEQ ID NO: 2434 - DNA, 16 bp, Artificial sequence
  Synthetic oligonucleotide
taggcaagcagctaaa

SEQ ID NO: 2435 - DNA, 16 bp, Artificial sequence
  Synthetic oligonucleotide
aaaactaaatggaccg

SEQ ID NO: 2436 - DNA, 16 bp, Artificial sequence
  Synthetic oligonucleotide
aaatttgaactgccca

SEQ ID NO: 2437 - DNA, 16 bp, Artificial sequence
  Synthetic oligonucleotide
atttactttggatgtc

SEQ ID NO: 2438 - DNA, 16 bp, Artificial sequence
  Synthetic oligonucleotide
aaacaacgaatgattg

SEQ ID NO: 2439 - DNA, 16 bp, Artificial sequence
  Synthetic oligonucleotide
ctttaggaaagggtat

SEQ ID NO: 2440 - DNA, 16 bp, Artificial sequence
  Synthetic oligonucleotide
tcattataatgggagg

SEQ ID NO: 2441 - DNA, 16 bp, Artificial sequence
  Synthetic oligonucleotide
gcccaaggaggaaatc

SEQ ID NO: 2442 - DNA, 16 bp, Artificial sequence
  Synthetic oligonucleotide
ccttaacactggtaag

SEQ ID NO: 2443 - DNA, 16 bp, Artificial sequence
  Synthetic oligonucleotide
taattacgattagatc

SEQ ID NO: 2444 - DNA, 16 bp, Artificial sequence
  Synthetic oligonucleotide
cgaatatagaaaaatg

SEQ ID NO: 2445 - DNA, 16 bp, Artificial sequence
  Synthetic oligonucleotide
cataacttgatgactc

SEQ ID NO: 2446 - DNA, 16 bp, Artificial sequence
  Synthetic oligonucleotide
cataggtaggcaacaa

SEQ ID NO: 2447 - DNA, 16 bp, Artificial sequence
  Synthetic oligonucleotide
taccaaaactacaacc

SEQ ID NO: 2448 - DNA, 16 bp, Artificial sequence
  Synthetic oligonucleotide
caaaaagggtaaggca

SEQ ID NO: 2449 - DNA, 16 bp, Artificial sequence
  Synthetic oligonucleotide
gattaacagagctaga

SEQ ID NO: 2450 - DNA, 16 bp, Artificial sequence
  Synthetic oligonucleotide
tagcaacacatgaaga

SEQ ID NO: 2451 - DNA, 16 bp, Artificial sequence
  Synthetic oligonucleotide
gtacaacctagtgata

SEQ ID NO: 2452 - DNA, 16 bp, Artificial sequence
  Synthetic oligonucleotide
cttaagggatggaaca

SEQ ID NO: 2453 - DNA, 16 bp, Artificial sequence
  Synthetic oligonucleotide
caaatagatactaagc

SEQ ID NO: 2454 - DNA, 16 bp, Artificial sequence
  Synthetic oligonucleotide
tatgaacaagtatgag

SEQ ID NO: 2455 - DNA, 16 bp, Artificial sequence
  Synthetic oligonucleotide
aataaacacctcgcca

SEQ ID NO: 2456 - DNA, 16 bp, Artificial sequence
  Synthetic oligonucleotide
caaatttagttgtgca

SEQ ID NO: 2457 - DNA, 16 bp, Artificial sequence
  Synthetic oligonucleotide
gatttatactcaggtt

SEQ ID NO: 2458 - DNA, 16 bp, Artificial sequence
  Synthetic oligonucleotide
ccccaatattatctac

SEQ ID NO: 2459 - DNA, 16 bp, Artificial sequence
  Synthetic oligonucleotide
atttaggctttgggtt

SEQ ID NO: 2460 - DNA, 16 bp, Artificial sequence
  Synthetic oligonucleotide
gtaattatatacccac

SEQ ID NO: 2461 - DNA, 16 bp, Artificial sequence
  Synthetic oligonucleotide
atactatacctaagga

SEQ ID NO: 2462 - DNA, 16 bp, Artificial sequence
  Synthetic oligonucleotide
acttatcactctgccc

SEQ ID NO: 2463 - DNA, 16 bp, Artificial sequence
  Synthetic oligonucleotide
agattaaaagtaggcc

SEQ ID NO: 2464 - DNA, 16 bp, Artificial sequence
  Synthetic oligonucleotide
tttaatactctctggg

SEQ ID NO: 2465 - DNA, 16 bp, Artificial sequence
  Synthetic oligonucleotide
gacctataatacagaa

SEQ ID NO: 2466 - DNA, 16 bp, Artificial sequence
  Synthetic oligonucleotide
gaagaatatcgaaaag

SEQ ID NO: 2467 - DNA, 16 bp, Artificial sequence
  Synthetic oligonucleotide
cactaataggatggat

SEQ ID NO: 2468 - DNA, 16 bp, Artificial sequence
  Synthetic oligonucleotide
cttaactattcagccc

SEQ ID NO: 2469 - DNA, 16 bp, Artificial sequence
  Synthetic oligonucleotide
cgctataaagtggcat

SEQ ID NO: 2470 - DNA, 16 bp, Artificial sequence
  Synthetic oligonucleotide
cattagtaagctgagg

SEQ ID NO: 2471 - DNA, 16 bp, Artificial sequence
  Synthetic oligonucleotide
attaactcacgaagac

SEQ ID NO: 2472 - DNA, 16 bp, Artificial sequence
  Synthetic oligonucleotide
aattagccaaccacct

SEQ ID NO: 2473 - DNA, 16 bp, Artificial sequence
  Synthetic oligonucleotide
aatttatatgctccct

SEQ ID NO: 2474 - DNA, 16 bp, Artificial sequence
  Synthetic oligonucleotide
atattcgatgtaactt

SEQ ID NO: 2475 - DNA, 16 bp, Artificial sequence
  Synthetic oligonucleotide
gtattagataaagcag

SEQ ID NO: 2476 - DNA, 16 bp, Artificial sequence
  Synthetic oligonucleotide
gtaattacctctaatc

SEQ ID NO: 2477 - DNA, 16 bp, Artificial sequence
  Synthetic oligonucleotide
cagcaatactgtgggc

SEQ ID NO: 2478 - DNA, 16 bp, Artificial sequence
  Synthetic oligonucleotide
taagaacgaacctcca

SEQ ID NO: 2479 - DNA, 16 bp, Artificial sequence
  Synthetic oligonucleotide
atttaagacctggtga

SEQ ID NO: 2480 - DNA, 16 bp, Artificial sequence
  Synthetic oligonucleotide
cgtaaacatcatctct

SEQ ID NO: 2481 - DNA, 16 bp, Artificial sequence
  Synthetic oligonucleotide
gtatttagagcttaag

SEQ ID NO: 2482 - DNA, 16 bp, Artificial sequence
  Synthetic oligonucleotide
gctaatatatccaatt

SEQ ID NO: 2483 - DNA, 16 bp, Artificial sequence
  Synthetic oligonucleotide
actataaagggtttag

SEQ ID NO: 2484 - DNA, 16 bp, Artificial sequence
  Synthetic oligonucleotide
caaagtaattaaacga

SEQ ID NO: 2485 - DNA, 16 bp, Artificial sequence
  Synthetic oligonucleotide
cggccccgcatccccc

SEQ ID NO: 2486 - DNA, 16 bp, Artificial sequence
  Synthetic oligonucleotide
ccaggcgagcgagggc

SEQ ID NO: 2487 - DNA, 16 bp, Artificial sequence
  Synthetic oligonucleotide
gcccgggtccggacgg

SEQ ID NO: 2488 - DNA, 16 bp, Artificial sequence
  Synthetic oligonucleotide
gactgtcgaagatgct

SEQ ID NO: 2489 - DNA, 16 bp, Artificial sequence
  Synthetic oligonucleotide
gttcatcatattctgc

SEQ ID NO: 2490 - DNA, 16 bp, Artificial sequence
  Synthetic oligonucleotide
ctgtttcactggagca

SEQ ID NO: 2491 - DNA, 16 bp, Artificial sequence
  Synthetic oligonucleotide
gcagggctaactcctg

SEQ ID NO: 2492 - DNA, 16 bp, Artificial sequence
  Synthetic oligonucleotide
gagggacactgtagct

SEQ ID NO: 2493 - DNA, 16 bp, Artificial sequence
  Synthetic oligonucleotide
gacttggcatcagctc

SEQ ID NO: 2494 - DNA, 16 bp, Artificial sequence
  Synthetic oligonucleotide
gattctttagagccaa

SEQ ID NO: 2495 - DNA, 16 bp, Artificial sequence
  Synthetic oligonucleotide
tgactaatgatagcac

SEQ ID NO: 2496 - DNA, 16 bp, Artificial sequence
  Synthetic oligonucleotide
tcactaatatggtcat

SEQ ID NO: 2497 - DNA, 16 bp, Artificial sequence
  Synthetic oligonucleotide
ttaactggaaagcagg

SEQ ID NO: 2498 - DNA, 16 bp, Artificial sequence
  Synthetic oligonucleotide
atctaccgtatgccca

SEQ ID NO: 2499 - DNA, 16 bp, Artificial sequence
  Synthetic oligonucleotide
accactataaagctta

SEQ ID NO: 2500 - DNA, 16 bp, Artificial sequence
  Synthetic oligonucleotide
atagcttatattgaag

SEQ ID NO: 2501 - DNA, 16 bp, Artificial sequence
  Synthetic oligonucleotide
attgaagggccaaaat

SEQ ID NO: 2502 - DNA, 16 bp, Artificial sequence
  Synthetic oligonucleotide
caaattataggcactc

SEQ ID NO: 2503 - DNA, 16 bp, Artificial sequence
  Synthetic oligonucleotide
ctttaatggcagcacg

SEQ ID NO: 2504 - DNA, 16 bp, Artificial sequence
  Synthetic oligonucleotide
ggactcttaggtctcc

SEQ ID NO: 2505 - DNA, 16 bp, Artificial sequence
  Synthetic oligonucleotide
agttaaaatcttatcc

SEQ ID NO: 2506 - DNA, 16 bp, Artificial sequence
  Synthetic oligonucleotide
tagcaaagtcacttcc

SEQ ID NO: 2507 - DNA, 16 bp, Artificial sequence
  Synthetic oligonucleotide
aacaacatgcttgcga

SEQ ID NO: 2508 - DNA, 16 bp, Artificial sequence
  Synthetic oligonucleotide
gtacctaacatatgag

SEQ ID NO: 2509 - DNA, 16 bp, Artificial sequence
  Synthetic oligonucleotide
attaacttttgggcaa

SEQ ID NO: 2510 - DNA, 16 bp, Artificial sequence
  Synthetic oligonucleotide
ggagactatacaacag

SEQ ID NO: 2511 - DNA, 16 bp, Artificial sequence
  Synthetic oligonucleotide
ttaggcaagcagctaa

SEQ ID NO: 2512 - DNA, 16 bp, Artificial sequence
  Synthetic oligonucleotide
aataaatgcttacggg

SEQ ID NO: 2513 - DNA, 16 bp, Artificial sequence
  Synthetic oligonucleotide
aaaaatcaagccctcg

SEQ ID NO: 2514 - DNA, 16 bp, Artificial sequence
  Synthetic oligonucleotide
gtttaacaatctcccc

SEQ ID NO: 2515 - DNA, 16 bp, Artificial sequence
  Synthetic oligonucleotide
ttaaaacaacgaatga

SEQ ID NO: 2516 - DNA, 16 bp, Artificial sequence
  Synthetic oligonucleotide
gtaaaaacctgggttt

SEQ ID NO: 2517 - DNA, 16 bp, Artificial sequence
  Synthetic oligonucleotide
attatatgactctgct

SEQ ID NO: 2518 - DNA, 16 bp, Artificial sequence
  Synthetic oligonucleotide
agtcaacctgtaatta

SEQ ID NO: 2519 - DNA, 16 bp, Artificial sequence
  Synthetic oligonucleotide
aattttaactgtgacc

SEQ ID NO: 2520 - DNA, 16 bp, Artificial sequence
  Synthetic oligonucleotide
ttaattacgattagat

SEQ ID NO: 2521 - DNA, 16 bp, Artificial sequence
  Synthetic oligonucleotide
cttttcgaatatagaa

SEQ ID NO: 2522 - DNA, 16 bp, Artificial sequence
  Synthetic oligonucleotide
gtatatagatacccac

SEQ ID NO: 2523 - DNA, 16 bp, Artificial sequence
  Synthetic oligonucleotide
tcacaaaaccctacac

SEQ ID NO: 2524 - DNA, 16 bp, Artificial sequence
  Synthetic oligonucleotide
actaaaactgactgtc

SEQ ID NO: 2525 - DNA, 16 bp, Artificial sequence
  Synthetic oligonucleotide
tccaaaaagggtaagg

SEQ ID NO: 2526 - DNA, 16 bp, Artificial sequence
  Synthetic oligonucleotide
ataaatcctcatgtgg

SEQ ID NO: 2527 - DNA, 16 bp, Artificial sequence
  Synthetic oligonucleotide
tcttatcctacagctt

SEQ ID NO: 2528 - DNA, 16 bp, Artificial sequence
  Synthetic oligonucleotide
gaaaaaggtttagggt

SEQ ID NO: 2529 - DNA, 16 bp, Artificial sequence
  Synthetic oligonucleotide
gcttaagggatggaac

SEQ ID NO: 2530 - DNA, 16 bp, Artificial sequence
  Synthetic oligonucleotide
caatttaactgttaca

SEQ ID NO: 2531 - DNA, 16 bp, Artificial sequence
  Synthetic oligonucleotide
ataattaagctatcac

SEQ ID NO: 2532 - DNA, 16 bp, Artificial sequence
  Synthetic oligonucleotide
caataaacacctcgcc

SEQ ID NO: 2533 - DNA, 16 bp, Artificial sequence
  Synthetic oligonucleotide
aattattggtgacact

SEQ ID NO: 2534 - DNA, 16 bp, Artificial sequence
  Synthetic oligonucleotide
gccaaataagaggtag

SEQ ID NO: 2535 - DNA, 16 bp, Artificial sequence
  Synthetic oligonucleotide
aataacctcgagtgct

SEQ ID NO: 2536 - DNA, 16 bp, Artificial sequence
  Synthetic oligonucleotide
cttcaaggaaggtgct

SEQ ID NO: 2537 - DNA, 16 bp, Artificial sequence
  Synthetic oligonucleotide
agtaattatataccca

SEQ ID NO: 2538 - DNA, 16 bp, Artificial sequence
  Synthetic oligonucleotide
ttagaatagttctacc

SEQ ID NO: 2539 - DNA, 16 bp, Artificial sequence
  Synthetic oligonucleotide
aactataagctatgtg

SEQ ID NO: 2540 - DNA, 16 bp, Artificial sequence
  Synthetic oligonucleotide
caccaataccaaagtc

SEQ ID NO: 2541 - DNA, 16 bp, Artificial sequence
  Synthetic oligonucleotide
atttaatactctctgg

SEQ ID NO: 2542 - DNA, 16 bp, Artificial sequence
  Synthetic oligonucleotide
tataaagcaatgcgat

SEQ ID NO: 2543 - DNA, 16 bp, Artificial sequence
  Synthetic oligonucleotide
aattaagcttctctag

SEQ ID NO: 2544 - DNA, 16 bp, Artificial sequence
  Synthetic oligonucleotide
ccccaacactaatagg

SEQ ID NO: 2545 - DNA, 16 bp, Artificial sequence
  Synthetic oligonucleotide
gcaataaagctgaact

SEQ ID NO: 2546 - DNA, 16 bp, Artificial sequence
  Synthetic oligonucleotide
catcaatagagagtcg

SEQ ID NO: 2547 - DNA, 16 bp, Artificial sequence
  Synthetic oligonucleotide
gaaaatagcccattag

SEQ ID NO: 2548 - DNA, 16 bp, Artificial sequence
  Synthetic oligonucleotide
tattaactcacgaaga

SEQ ID NO: 2549 - DNA, 16 bp, Artificial sequence
  Synthetic oligonucleotide
ataattagccaaccac

SEQ ID NO: 2550 - DNA, 16 bp, Artificial sequence
  Synthetic oligonucleotide
caaatttatatgctcc

SEQ ID NO: 2551 - DNA, 16 bp, Artificial sequence
  Synthetic oligonucleotide
caatttgggatattcg

SEQ ID NO: 2552 - DNA, 16 bp, Artificial sequence
  Synthetic oligonucleotide
ctttaggagtcagaac

SEQ ID NO: 2553 - DNA, 16 bp, Artificial sequence
  Synthetic oligonucleotide
agtaattacctctaat

SEQ ID NO: 2554 - DNA, 16 bp, Artificial sequence
  Synthetic oligonucleotide
taatatcctcatcagc

SEQ ID NO: 2555 - DNA, 16 bp, Artificial sequence
  Synthetic oligonucleotide
caataagaacgaacct

SEQ ID NO: 2556 - DNA, 16 bp, Artificial sequence
  Synthetic oligonucleotide
tatttaagacctggtg

SEQ ID NO: 2557 - DNA, 16 bp, Artificial sequence
  Synthetic oligonucleotide
cattactactctgtcc

SEQ ID NO: 2558 - DNA, 16 bp, Artificial sequence
  Synthetic oligonucleotide
cattactactaagagt

SEQ ID NO: 2559 - DNA, 16 bp, Artificial sequence
  Synthetic oligonucleotide
caattaagatcaacat

SEQ ID NO: 2560 - DNA, 16 bp, Artificial sequence
  Synthetic oligonucleotide
atttttaggcagacgc

SEQ ID NO: 2561 - DNA, 16 bp, Artificial sequence
  Synthetic oligonucleotide
taaagtaatgctacag

SEQ ID NO: 2562 - DNA, 16 bp, Artificial sequence
  Synthetic oligonucleotide
gcggccccgcatcccc

SEQ ID NO: 2563 - DNA, 16 bp, Artificial sequence
  Synthetic oligonucleotide
cccaggcgagcgaggg

SEQ ID NO: 2564 - DNA, 16 bp, Artificial sequence
  Synthetic oligonucleotide
tgcccgggtccggacg

SEQ ID NO: 2565 - DNA, 16 bp, Artificial sequence
  Synthetic oligonucleotide
gaagactgtcgaagat

SEQ ID NO: 2566 - DNA, 16 bp, Artificial sequence
  Synthetic oligonucleotide
ccgagttcatcatatt

SEQ ID NO: 2567 - DNA, 16 bp, Artificial sequence
  Synthetic oligonucleotide
gctgtttcactggagc

SEQ ID NO: 2568 - DNA, 16 bp, Artificial sequence
  Synthetic oligonucleotide
cgcagggctaactcct

SEQ ID NO: 2569 - DNA, 16 bp, Artificial sequence
  Synthetic oligonucleotide
cgagggacactgtagc

SEQ ID NO: 2570 - DNA, 16 bp, Artificial sequence
  Synthetic oligonucleotide
gcagacttggcatcag

SEQ ID NO: 2571 - DNA, 16 bp, Artificial sequence
  Synthetic oligonucleotide
tgattctttagagcca

SEQ ID NO: 2572 - DNA, 16 bp, Artificial sequence
  Synthetic oligonucleotide
gtgactaatgatagca

SEQ ID NO: 2573 - DNA, 16 bp, Artificial sequence
  Synthetic oligonucleotide
ttcactaatatggtca

SEQ ID NO: 2574 - DNA, 16 bp, Artificial sequence
  Synthetic oligonucleotide
aatgcatacaaagcgc

SEQ ID NO: 2575 - DNA, 16 bp, Artificial sequence
  Synthetic oligonucleotide
tatctaccgtatgccc

SEQ ID NO: 2576 - DNA, 16 bp, Artificial sequence
  Synthetic oligonucleotide
aaccactataaagctt

SEQ ID NO: 2577 - DNA, 16 bp, Artificial sequence
  Synthetic oligonucleotide
catagcttatattgaa

SEQ ID NO: 2578 - DNA, 16 bp, Artificial sequence
  Synthetic oligonucleotide
aattgaagggccaaaa

SEQ ID NO: 2579 - DNA, 16 bp, Artificial sequence
  Synthetic oligonucleotide
ctactggcaaattata

SEQ ID NO: 2580 - DNA, 16 bp, Artificial sequence
  Synthetic oligonucleotide
tctagaacagctgcct

SEQ ID NO: 2581 - DNA, 16 bp, Artificial sequence
  Synthetic oligonucleotide
aaggactcttaggtct

SEQ ID NO: 2582 - DNA, 16 bp, Artificial sequence
  Synthetic oligonucleotide
cagttaaaatcttatc

SEQ ID NO: 2583 - DNA, 16 bp, Artificial sequence
  Synthetic oligonucleotide
gtagcaaagtcacttc

SEQ ID NO: 2584 - DNA, 16 bp, Artificial sequence
  Synthetic oligonucleotide
taacaacatgcttgcg

SEQ ID NO: 2585 - DNA, 16 bp, Artificial sequence
  Synthetic oligonucleotide
agtacctaacatatga

SEQ ID NO: 2586 - DNA, 16 bp, Artificial sequence
  Synthetic oligonucleotide
tattaacttttgggca

SEQ ID NO: 2587 - DNA, 16 bp, Artificial sequence
  Synthetic oligonucleotide
aggagactatacaaca

SEQ ID NO: 2588 - DNA, 16 bp, Artificial sequence
  Synthetic oligonucleotide
gtgtttaggcaagcag

SEQ ID NO: 2589 - DNA, 16 bp, Artificial sequence
  Synthetic oligonucleotide
gccgcgaggaaaataa

SEQ ID NO: 2590 - DNA, 16 bp, Artificial sequence
  Synthetic oligonucleotide
atattcgacactggag

SEQ ID NO: 2591 - DNA, 16 bp, Artificial sequence
  Synthetic oligonucleotide
ccttatacttttagcc

SEQ ID NO: 2592 - DNA, 16 bp, Artificial sequence
  Synthetic oligonucleotide
caaagtaaggtatgag

SEQ ID NO: 2593 - DNA, 16 bp, Artificial sequence
  Synthetic oligonucleotide
cttaaggtacaaggca

SEQ ID NO: 2594 - DNA, 16 bp, Artificial sequence
  Synthetic oligonucleotide
ccagaaaatcatagta

SEQ ID NO: 2595 - DNA, 16 bp, Artificial sequence
  Synthetic oligonucleotide
gctaatagtcactgtt

SEQ ID NO: 2596 - DNA, 16 bp, Artificial sequence
  Synthetic oligonucleotide
cattatccgggagagc

SEQ ID NO: 2597 - DNA, 16 bp, Artificial sequence
  Synthetic oligonucleotide
gttaattacgattaga

SEQ ID NO: 2598 - DNA, 16 bp, Artificial sequence
  Synthetic oligonucleotide
tatacatagtcaattc

SEQ ID NO: 2599 - DNA, 16 bp, Artificial sequence
  Synthetic oligonucleotide
gtattcgcctcctgca

SEQ ID NO: 2600 - DNA, 16 bp, Artificial sequence
  Synthetic oligonucleotide
attaaagctcattgat

SEQ ID NO: 2601 - DNA, 16 bp, Artificial sequence
  Synthetic oligonucleotide
tattaccctactcata

SEQ ID NO: 2602 - DNA, 16 bp, Artificial sequence
  Synthetic oligonucleotide
cataactacatcgaca

SEQ ID NO: 2603 - DNA, 16 bp, Artificial sequence
  Synthetic oligonucleotide
tataaatcctcatgtg

SEQ ID NO: 2604 - DNA, 16 bp, Artificial sequence
  Synthetic oligonucleotide
ctttatctcactagct

SEQ ID NO: 2605 - DNA, 16 bp, Artificial sequence
  Synthetic oligonucleotide
cataatccctgacttg

SEQ ID NO: 2606 - DNA, 16 bp, Artificial sequence
  Synthetic oligonucleotide
gctcaaaactgacata

SEQ ID NO: 2607 - DNA, 16 bp, Artificial sequence
  Synthetic oligonucleotide
aaggaaccttctgtgt

SEQ ID NO: 2608 - DNA, 16 bp, Artificial sequence
  Synthetic oligonucleotide
cgtaaacattttgcct

SEQ ID NO: 2609 - DNA, 16 bp, Artificial sequence
  Synthetic oligonucleotide
ccacaacctgtcaata

SEQ ID NO: 2610 - DNA, 16 bp, Artificial sequence
  Synthetic oligonucleotide
aaattattggtgacac

SEQ ID NO: 2611 - DNA, 16 bp, Artificial sequence
  Synthetic oligonucleotide
aattactagaggcttc

SEQ ID NO: 2612 - DNA, 16 bp, Artificial sequence
  Synthetic oligonucleotide
caataacctcgagtgc

SEQ ID NO: 2613 - DNA, 16 bp, Artificial sequence
  Synthetic oligonucleotide
cttaaggcagctctat

SEQ ID NO: 2614 - DNA, 16 bp, Artificial sequence
  Synthetic oligonucleotide
gataatcatgatactc

SEQ ID NO: 2615 - DNA, 16 bp, Artificial sequence
  Synthetic oligonucleotide
actcaatagatcattg

SEQ ID NO: 2616 - DNA, 16 bp, Artificial sequence
  Synthetic oligonucleotide
taactataagctatgt

SEQ ID NO: 2617 - DNA, 16 bp, Artificial sequence
  Synthetic oligonucleotide
cgtgaaaaagatgtgg

SEQ ID NO: 2618 - DNA, 16 bp, Artificial sequence
  Synthetic oligonucleotide
aacctatattatttgc

SEQ ID NO: 2619 - DNA, 16 bp, Artificial sequence
  Synthetic oligonucleotide
ctataaagcaatgcga

SEQ ID NO: 2620 - DNA, 16 bp, Artificial sequence
  Synthetic oligonucleotide
gctaaaattaagcttc

SEQ ID NO: 2621 - DNA, 16 bp, Artificial sequence
  Synthetic oligonucleotide
cattaataaagttacc

SEQ ID NO: 2622 - DNA, 16 bp, Artificial sequence
  Synthetic oligonucleotide
taccaacaaggcatca

SEQ ID NO: 2623 - DNA, 16 bp, Artificial sequence
  Synthetic oligonucleotide
actaataggccatctg

SEQ ID NO: 2624 - DNA, 16 bp, Artificial sequence
  Synthetic oligonucleotide
ctagaaaatagcccat

SEQ ID NO: 2625 - DNA, 16 bp, Artificial sequence
  Synthetic oligonucleotide
ttattaactcacgaag

SEQ ID NO: 2626 - DNA, 16 bp, Artificial sequence
  Synthetic oligonucleotide
tataattagccaacca

SEQ ID NO: 2627 - DNA, 16 bp, Artificial sequence
  Synthetic oligonucleotide
tctcaaggaattgcct

SEQ ID NO: 2628 - DNA, 16 bp, Artificial sequence
  Synthetic oligonucleotide
cctaaaaaactagtga

SEQ ID NO: 2629 - DNA, 16 bp, Artificial sequence
  Synthetic oligonucleotide
gctaaaacatcagata

SEQ ID NO: 2630 - DNA, 16 bp, Artificial sequence
  Synthetic oligonucleotide
gataactttccacaat

SEQ ID NO: 2631 - DNA, 16 bp, Artificial sequence
  Synthetic oligonucleotide
attaactacaactgtg

SEQ ID NO: 2632 - DNA, 16 bp, Artificial sequence
  Synthetic oligonucleotide
aacggatatacaataa

SEQ ID NO: 2633 - DNA, 16 bp, Artificial sequence
  Synthetic oligonucleotide
ttatttaagacctggt

SEQ ID NO: 2634 - DNA, 16 bp, Artificial sequence
  Synthetic oligonucleotide
gaagaatagcatctga

SEQ ID NO: 2635 - DNA, 16 bp, Artificial sequence
  Synthetic oligonucleotide
gtaaaagggaactaag

SEQ ID NO: 2636 - DNA, 16 bp, Artificial sequence
  Synthetic oligonucleotide
cataacacttaaggtg

SEQ ID NO: 2637 - DNA, 16 bp, Artificial sequence
  Synthetic oligonucleotide
atttttagtccagtgg

SEQ ID NO: 2638 - DNA, 16 bp, Artificial sequence
  Synthetic oligonucleotide
cattaagtcacagcat

SEQ ID NO: 2639 - DNA, 16 bp, Artificial sequence
  Synthetic oligonucleotide
cgcggccccgcatccc

SEQ ID NO: 2640 - DNA, 16 bp, Artificial sequence
  Synthetic oligonucleotide
acccaggcgagcgagg

SEQ ID NO: 2641 - DNA, 16 bp, Artificial sequence
  Synthetic oligonucleotide
ttgcccgggtccggac

SEQ ID NO: 2642 - DNA, 16 bp, Artificial sequence
  Synthetic oligonucleotide
aagaagactgtcgaag

SEQ ID NO: 2643 - DNA, 16 bp, Artificial sequence
  Synthetic oligonucleotide
gccgagttcatcatat

SEQ ID NO: 2644 - DNA, 16 bp, Artificial sequence
  Synthetic oligonucleotide
ttggagttgctgccac

SEQ ID NO: 2645 - DNA, 16 bp, Artificial sequence
  Synthetic oligonucleotide
acgcagggctaactcc

SEQ ID NO: 2646 - DNA, 16 bp, Artificial sequence
  Synthetic oligonucleotide
tcgagggacactgtag

SEQ ID NO: 2647 - DNA, 16 bp, Artificial sequence
  Synthetic oligonucleotide
ctgcagacttggcatc

SEQ ID NO: 2648 - DNA, 16 bp, Artificial sequence
  Synthetic oligonucleotide
aaacaggctcacttcc

SEQ ID NO: 2649 - DNA, 16 bp, Artificial sequence
  Synthetic oligonucleotide
tgtgactaatgatagc

SEQ ID NO: 2650 - DNA, 16 bp, Artificial sequence
  Synthetic oligonucleotide
attcactaatatggtc

SEQ ID NO: 2651 - DNA, 16 bp, Artificial sequence
  Synthetic oligonucleotide
aaatgcatacaaagcg

SEQ ID NO: 2652 - DNA, 16 bp, Artificial sequence
  Synthetic oligonucleotide
atatctaccgtatgcc

SEQ ID NO: 2653 - DNA, 16 bp, Artificial sequence
  Synthetic oligonucleotide
taaaccactataaagc

SEQ ID NO: 2654 - DNA, 16 bp, Artificial sequence
  Synthetic oligonucleotide
tcatagcttatattga

SEQ ID NO: 2655 - DNA, 16 bp, Artificial sequence
  Synthetic oligonucleotide
aaattgaagggccaaa

SEQ ID NO: 2656 - DNA, 16 bp, Artificial sequence
  Synthetic oligonucleotide
taatctgtggctactg

SEQ ID NO: 2657 - DNA, 16 bp, Artificial sequence
  Synthetic oligonucleotide
ctctagaacagctgcc

SEQ ID NO: 2658 - DNA, 16 bp, Artificial sequence
  Synthetic oligonucleotide
aaaggactcttaggtc

SEQ ID NO: 2659 - DNA, 16 bp, Artificial sequence
  Synthetic oligonucleotide
caagaatacccagtta

SEQ ID NO: 2660 - DNA, 16 bp, Artificial sequence
  Synthetic oligonucleotide
ttgtagcaaagtcact

SEQ ID NO: 2661 - DNA, 16 bp, Artificial sequence
  Synthetic oligonucleotide
ataacaacatgcttgc

SEQ ID NO: 2662 - DNA, 16 bp, Artificial sequence
  Synthetic oligonucleotide
gtaagtacctaacata

SEQ ID NO: 2663 - DNA, 16 bp, Artificial sequence
  Synthetic oligonucleotide
ctattaacttttgggc

SEQ ID NO: 2664 - DNA, 16 bp, Artificial sequence
  Synthetic oligonucleotide
caggagactatacaac

SEQ ID NO: 2665 - DNA, 16 bp, Artificial sequence
  Synthetic oligonucleotide
attgaagtgtttaggc

SEQ ID NO: 2666 - DNA, 16 bp, Artificial sequence
  Synthetic oligonucleotide
cacgcgacctactaag

SEQ ID NO: 2667 - DNA, 16 bp, Artificial sequence
  Synthetic oligonucleotide
ttaatattcgacactg

SEQ ID NO: 2668 - DNA, 16 bp, Artificial sequence
  Synthetic oligonucleotide
ctttaaccttatactt

SEQ ID NO: 2669 - DNA, 16 bp, Artificial sequence
  Synthetic oligonucleotide
gataaatgtaactagc

SEQ ID NO: 2670 - DNA, 16 bp, Artificial sequence
  Synthetic oligonucleotide
cttaaatcttagcaac

SEQ ID NO: 2671 - DNA, 16 bp, Artificial sequence
  Synthetic oligonucleotide
cggcaaaaacaaaatc

SEQ ID NO: 2672 - DNA, 16 bp, Artificial sequence
  Synthetic oligonucleotide
tatcaaggattcagta

SEQ ID NO: 2673 - DNA, 16 bp, Artificial sequence
  Synthetic oligonucleotide
gtatttggacaactct

SEQ ID NO: 2674 - DNA, 16 bp, Artificial sequence
  Synthetic oligonucleotide
tcccaaaagtcatcgc

SEQ ID NO: 2675 - DNA, 16 bp, Artificial sequence
  Synthetic oligonucleotide
attacggacagaagtg

SEQ ID NO: 2676 - DNA, 16 bp, Artificial sequence
  Synthetic oligonucleotide
atcctaaagccactgc

SEQ ID NO: 2677 - DNA, 16 bp, Artificial sequence
  Synthetic oligonucleotide
gattaaagctcattga

SEQ ID NO: 2678 - DNA, 16 bp, Artificial sequence
  Synthetic oligonucleotide
attattaccctactca

SEQ ID NO: 2679 - DNA, 16 bp, Artificial sequence
  Synthetic oligonucleotide
catactaatccctctt

SEQ ID NO: 2680 - DNA, 16 bp, Artificial sequence
  Synthetic oligonucleotide
ctataaatcctcatgt

SEQ ID NO: 2681 - DNA, 16 bp, Artificial sequence
  Synthetic oligonucleotide
cattttgaacccttta

SEQ ID NO: 2682 - DNA, 16 bp, Artificial sequence
  Synthetic oligonucleotide
gaataacacataatcc

SEQ ID NO: 2683 - DNA, 16 bp, Artificial sequence
  Synthetic oligonucleotide
tgagaaaggttcctga

SEQ ID NO: 2684 - DNA, 16 bp, Artificial sequence
  Synthetic oligonucleotide
agtcaaggaaccttct

SEQ ID NO: 2685 - DNA, 16 bp, Artificial sequence
  Synthetic oligonucleotide
gctaaacctacacgct

SEQ ID NO: 2686 - DNA, 16 bp, Artificial sequence
  Synthetic oligonucleotide
attaaccagaagcctg

SEQ ID NO: 2687 - DNA, 16 bp, Artificial sequence
  Synthetic oligonucleotide
tatatatgatggactg

SEQ ID NO: 2688 - DNA, 16 bp, Artificial sequence
  Synthetic oligonucleotide
gaggaagggcaccttt

SEQ ID NO: 2689 - DNA, 16 bp, Artificial sequence
  Synthetic oligonucleotide
aggcaataacctcgag

SEQ ID NO: 2690 - DNA, 16 bp, Artificial sequence
  Synthetic oligonucleotide
ggagaacacaagaggc

SEQ ID NO: 2691 - DNA, 16 bp, Artificial sequence
  Synthetic oligonucleotide
atttagatagttactg

SEQ ID NO: 2692 - DNA, 16 bp, Artificial sequence
  Synthetic oligonucleotide
gatgaacactcaatag

SEQ ID NO: 2693 - DNA, 16 bp, Artificial sequence
  Synthetic oligonucleotide
ctaataacttgtctac

SEQ ID NO: 2694 - DNA, 16 bp, Artificial sequence
  Synthetic oligonucleotide
ctcgaaagctgggccc

SEQ ID NO: 2695 - DNA, 16 bp, Artificial sequence
  Synthetic oligonucleotide
gtagaacctatattat

SEQ ID NO: 2696 - DNA, 16 bp, Artificial sequence
  Synthetic oligonucleotide
cattatgacattcccc

SEQ ID NO: 2697 - DNA, 16 bp, Artificial sequence
  Synthetic oligonucleotide
cgttattatgcagcaa

SEQ ID NO: 2698 - DNA, 16 bp, Artificial sequence
  Synthetic oligonucleotide
taattagatgctgaca

SEQ ID NO: 2699 - DNA, 16 bp, Artificial sequence
  Synthetic oligonucleotide
cattagactttctgtc

SEQ ID NO: 2700 - DNA, 16 bp, Artificial sequence
  Synthetic oligonucleotide
aactaataggccatct

SEQ ID NO: 2701 - DNA, 16 bp, Artificial sequence
  Synthetic oligonucleotide
cgtaaattgaggccca

SEQ ID NO: 2702 - DNA, 16 bp, Artificial sequence
  Synthetic oligonucleotide
atttattaactcacga

SEQ ID NO: 2703 - DNA, 16 bp, Artificial sequence
  Synthetic oligonucleotide
ctataattagccaacc

SEQ ID NO: 2704 - DNA, 16 bp, Artificial sequence
  Synthetic oligonucleotide
atcctatacattaaga

SEQ ID NO: 2705 - DNA, 16 bp, Artificial sequence
  Synthetic oligonucleotide
tcctaaaaaactagtg

SEQ ID NO: 2706 - DNA, 16 bp, Artificial sequence
  Synthetic oligonucleotide
aataaggacaggaccc

SEQ ID NO: 2707 - DNA, 16 bp, Artificial sequence
  Synthetic oligonucleotide
accctatacttgaatt

SEQ ID NO: 2708 - DNA, 16 bp, Artificial sequence
  Synthetic oligonucleotide
cattaactacaactgt

SEQ ID NO: 2709 - DNA, 16 bp, Artificial sequence
  Synthetic oligonucleotide
ataacggatatacaat

SEQ ID NO: 2710 - DNA, 16 bp, Artificial sequence
  Synthetic oligonucleotide
attatttaagacctgg

SEQ ID NO: 2711 - DNA, 16 bp, Artificial sequence
  Synthetic oligonucleotide
taggaagaatagcatc

SEQ ID NO: 2712 - DNA, 16 bp, Artificial sequence
  Synthetic oligonucleotide
gataaagaggttaaca

SEQ ID NO: 2713 - DNA, 16 bp, Artificial sequence
  Synthetic oligonucleotide
caaagtaagtgagccc

SEQ ID NO: 2714 - DNA, 16 bp, Artificial sequence
  Synthetic oligonucleotide
actataaagcaatgcg

SEQ ID NO: 2715 - DNA, 16 bp, Artificial sequence
  Synthetic oligonucleotide
aattacagtgtctcac

SEQ ID NO: 2716 - DNA, 16 bp, Artificial sequence
  Synthetic oligonucleotide
ccgcggccccgcatcc

SEQ ID NO: 2717 - DNA, 16 bp, Artificial sequence
  Synthetic oligonucleotide
cgcaccccctgaccca

SEQ ID NO: 2718 - DNA, 16 bp, Artificial sequence
  Synthetic oligonucleotide
gccggttgcccgggtc

SEQ ID NO: 2719 - DNA, 16 bp, Artificial sequence
  Synthetic oligonucleotide
aaagaagactgtcgaa

SEQ ID NO: 2720 - DNA, 16 bp, Artificial sequence
  Synthetic oligonucleotide
agccgagttcatcata

SEQ ID NO: 2721 - DNA, 16 bp, Artificial sequence
  Synthetic oligonucleotide
tggttggagttgctgc

SEQ ID NO: 2722 - DNA, 16 bp, Artificial sequence
  Synthetic oligonucleotide
tacgcagggctaactc

SEQ ID NO: 2723 - DNA, 16 bp, Artificial sequence
  Synthetic oligonucleotide
ttcgagggacactgta

SEQ ID NO: 2724 - DNA, 16 bp, Artificial sequence
  Synthetic oligonucleotide
gtcagaactcaaagct

SEQ ID NO: 2725 - DNA, 16 bp, Artificial sequence
  Synthetic oligonucleotide
caaacaggctcacttc

SEQ ID NO: 2726 - DNA, 16 bp, Artificial sequence
  Synthetic oligonucleotide
cattatgtgactaatg

SEQ ID NO: 2727 - DNA, 16 bp, Artificial sequence
  Synthetic oligonucleotide
agattcactaatatgg

SEQ ID NO: 2728 - DNA, 16 bp, Artificial sequence
  Synthetic oligonucleotide
actactagtcatgtat

SEQ ID NO: 2729 - DNA, 16 bp, Artificial sequence
  Synthetic oligonucleotide
aatatctaccgtatgc

SEQ ID NO: 2730 - DNA, 16 bp, Artificial sequence
  Synthetic oligonucleotide
gtaaaccactataaag

SEQ ID NO: 2731 - DNA, 16 bp, Artificial sequence
  Synthetic oligonucleotide
ttcatagcttatattg

SEQ ID NO: 2732 - DNA, 16 bp, Artificial sequence
  Synthetic oligonucleotide
caaattgaagggccaa

SEQ ID NO: 2733 - DNA, 16 bp, Artificial sequence
  Synthetic oligonucleotide
tcttaatctgtggcta

SEQ ID NO: 2734 - DNA, 16 bp, Artificial sequence
  Synthetic oligonucleotide
actctagaacagctgc

SEQ ID NO: 2735 - DNA, 16 bp, Artificial sequence
  Synthetic oligonucleotide
gaaaggactcttaggt

SEQ ID NO: 2736 - DNA, 16 bp, Artificial sequence
  Synthetic oligonucleotide
ggtttattgtaaaagc

SEQ ID NO: 2737 - DNA, 16 bp, Artificial sequence
  Synthetic oligonucleotide
ccatatagaaggcatg

SEQ ID NO: 2738 - DNA, 16 bp, Artificial sequence
  Synthetic oligonucleotide
tataacaacatgcttg

SEQ ID NO: 2739 - DNA, 16 bp, Artificial sequence
  Synthetic oligonucleotide
tgtaagtacctaacat

SEQ ID NO: 2740 - DNA, 16 bp, Artificial sequence
  Synthetic oligonucleotide
cctattaacttttggg

SEQ ID NO: 2741 - DNA, 16 bp, Artificial sequence
  Synthetic oligonucleotide
acaggagactatacaa

SEQ ID NO: 2742 - DNA, 16 bp, Artificial sequence
  Synthetic oligonucleotide
gacaaattgaagtgtt

SEQ ID NO: 2743 - DNA, 16 bp, Artificial sequence
  Synthetic oligonucleotide
aaccaacacgcgacct

SEQ ID NO: 2744 - DNA, 16 bp, Artificial sequence
  Synthetic oligonucleotide
atttaatattcgacac

SEQ ID NO: 2745 - DNA, 16 bp, Artificial sequence
  Synthetic oligonucleotide
tacggaaggccaactg

SEQ ID NO: 2746 - DNA, 16 bp, Artificial sequence
  Synthetic oligonucleotide
cttgaaaacaagccac

SEQ ID NO: 2747 - DNA, 16 bp, Artificial sequence
  Synthetic oligonucleotide
gctaaattatgctatt

SEQ ID NO: 2748 - DNA, 16 bp, Artificial sequence
  Synthetic oligonucleotide
caaaaaatcacggcaa

SEQ ID NO: 2749 - DNA, 16 bp, Artificial sequence
  Synthetic oligonucleotide
acgggaaagaaaggcc

SEQ ID NO: 2750 - DNA, 16 bp, Artificial sequence
  Synthetic oligonucleotide
gttaaaagtgaaccca

SEQ ID NO: 2751 - DNA, 16 bp, Artificial sequence
  Synthetic oligonucleotide
aaatatccgtgtcctc

SEQ ID NO: 2752 - DNA, 16 bp, Artificial sequence
  Synthetic oligonucleotide
tattacggacagaagt

SEQ ID NO: 2753 - DNA, 16 bp, Artificial sequence
  Synthetic oligonucleotide
tataacaatcatccta

SEQ ID NO: 2754 - DNA, 16 bp, Artificial sequence
  Synthetic oligonucleotide
agattaaagctcattg

SEQ ID NO: 2755 - DNA, 16 bp, Artificial sequence
  Synthetic oligonucleotide
aattattaccctactc

SEQ ID NO: 2756 - DNA, 16 bp, Artificial sequence
  Synthetic oligonucleotide
cattaaatgacagcct

SEQ ID NO: 2757 - DNA, 16 bp, Artificial sequence
  Synthetic oligonucleotide
cactataaatcctcat

SEQ ID NO: 2758 - DNA, 16 bp, Artificial sequence
  Synthetic oligonucleotide
gacaataaatctgcct

SEQ ID NO: 2759 - DNA, 16 bp, Artificial sequence
  Synthetic oligonucleotide
caatattatctgagct

SEQ ID NO: 2760 - DNA, 16 bp, Artificial sequence
  Synthetic oligonucleotide
atatattaggagtttc

SEQ ID NO: 2761 - DNA, 16 bp, Artificial sequence
  Synthetic oligonucleotide
ttacaacacaagtcta

SEQ ID NO: 2762 - DNA, 16 bp, Artificial sequence
  Synthetic oligonucleotide
aaaacggtgtgaagaa

SEQ ID NO: 2763 - DNA, 16 bp, Artificial sequence
  Synthetic oligonucleotide
aattaaccagaagcct

SEQ ID NO: 2764 - DNA, 16 bp, Artificial sequence
  Synthetic oligonucleotide
gatatatatgatggac

SEQ ID NO: 2765 - DNA, 16 bp, Artificial sequence
  Synthetic oligonucleotide
ggagaaagccatcaag

SEQ ID NO: 2766 - DNA, 16 bp, Artificial sequence
  Synthetic oligonucleotide
gaatcgatgtgttgcg

SEQ ID NO: 2767 - DNA, 16 bp, Artificial sequence
  Synthetic oligonucleotide
tattacacaggcaggc

SEQ ID NO: 2768 - DNA, 16 bp, Artificial sequence
  Synthetic oligonucleotide
cctcaacacatttgag

SEQ ID NO: 2769 - DNA, 16 bp, Artificial sequence
  Synthetic oligonucleotide
tattagccttctaacc

SEQ ID NO: 2770 - DNA, 16 bp, Artificial sequence
  Synthetic oligonucleotide
cctaataacttgtcta

SEQ ID NO: 2771 - DNA, 16 bp, Artificial sequence
  Synthetic oligonucleotide
actcgaaagctgggcc

SEQ ID NO: 2772 - DNA, 16 bp, Artificial sequence
  Synthetic oligonucleotide
gcttaaaatcatgtag

SEQ ID NO: 2773 - DNA, 16 bp, Artificial sequence
  Synthetic oligonucleotide
gattattattgcagct

SEQ ID NO: 2774 - DNA, 16 bp, Artificial sequence
  Synthetic oligonucleotide
atataggaccacgact

SEQ ID NO: 2775 - DNA, 16 bp, Artificial sequence
  Synthetic oligonucleotide
ataattagatgctgac

SEQ ID NO: 2776 - DNA, 16 bp, Artificial sequence
  Synthetic oligonucleotide
aattactaacaatctc

SEQ ID NO: 2777 - DNA, 16 bp, Artificial sequence
  Synthetic oligonucleotide
caaactaataggccat

SEQ ID NO: 2778 - DNA, 16 bp, Artificial sequence
  Synthetic oligonucleotide
gttaaatatgaattgg

SEQ ID NO: 2779 - DNA, 16 bp, Artificial sequence
  Synthetic oligonucleotide
tatttattaactcacg

SEQ ID NO: 2780 - DNA, 16 bp, Artificial sequence
  Synthetic oligonucleotide
cttctataattagcca

SEQ ID NO: 2781 - DNA, 16 bp, Artificial sequence
  Synthetic oligonucleotide
ttataacagactggct

SEQ ID NO: 2782 - DNA, 16 bp, Artificial sequence
  Synthetic oligonucleotide
gaccaaaacagctctt

SEQ ID NO: 2783 - DNA, 16 bp, Artificial sequence
  Synthetic oligonucleotide
caataaggacaggacc

SEQ ID NO: 2784 - DNA, 16 bp, Artificial sequence
  Synthetic oligonucleotide
tataaccctatacttg

SEQ ID NO: 2785 - DNA, 16 bp, Artificial sequence
  Synthetic oligonucleotide
agactaaatcttccct

SEQ ID NO: 2786 - DNA, 16 bp, Artificial sequence
  Synthetic oligonucleotide
tataacggatatacaa

SEQ ID NO: 2787 - DNA, 16 bp, Artificial sequence
  Synthetic oligonucleotide
gtattatttaagacct

SEQ ID NO: 2788 - DNA, 16 bp, Artificial sequence
  Synthetic oligonucleotide
cttatatggttttgtg

SEQ ID NO: 2789 - DNA, 16 bp, Artificial sequence
  Synthetic oligonucleotide
cattagactaggcttt

SEQ ID NO: 2790 - DNA, 16 bp, Artificial sequence
  Synthetic oligonucleotide
aattacccctgtgagg

SEQ ID NO: 2791 - DNA, 16 bp, Artificial sequence
  Synthetic oligonucleotide
atttttagctcgcaat

SEQ ID NO: 2792 - DNA, 16 bp, Artificial sequence
  Synthetic oligonucleotide
gattacagtgacattc

SEQ ID NO: 2793 - DNA, 16 bp, Artificial sequence
  Synthetic oligonucleotide
ctcctgccgaagcagt

SEQ ID NO: 2794 - DNA, 16 bp, Artificial sequence
  Synthetic oligonucleotide
ctaactcctgccgaag

SEQ ID NO: 2795 - DNA, 16 bp, Artificial sequence
  Synthetic oligonucleotide
gctaactcctgccgaa

SEQ ID NO: 2796 - DNA, 16 bp, Artificial sequence
  Synthetic oligonucleotide
ggctaactcctgccga

SEQ ID NO: 2797 - DNA, 16 bp, Artificial sequence
  Synthetic oligonucleotide
gggctaactcctgccg

SEQ ID NO: 2798 - DNA, 16 bp, Artificial sequence
  Synthetic oligonucleotide
agggctaactcctgcc

SEQ ID NO: 2799 - DNA, 16 bp, Artificial sequence
  Synthetic oligonucleotide
cagggctaactcctgc

SEQ ID NO: 2800 - DNA, 16 bp, Artificial sequence
  Synthetic oligonucleotide
gaaattgtctcatgcc

SEQ ID NO: 2801 - DNA, 16 bp, Artificial sequence
  Synthetic oligonucleotide
ctgaggtataactggg

SEQ ID NO: 2802 - DNA, 16 bp, Artificial sequence
  Synthetic oligonucleotide
cactgaggtataactg

SEQ ID NO: 2803 - DNA, 16 bp, Artificial sequence
  Synthetic oligonucleotide
tgtctcatgccttata

SEQ ID NO: 2804 - DNA, 16 bp, Artificial sequence
  Synthetic oligonucleotide
attgtctcatgcctta

SEQ ID NO: 2805 - DNA, 16 bp, Artificial sequence
  Synthetic oligonucleotide
aattgtctcatgcctt

SEQ ID NO: 2806 - DNA, 16 bp, Artificial sequence
  Synthetic oligonucleotide
ggaaattgtctcatgc

SEQ ID NO: 2807 - DNA, 16 bp, Artificial sequence
  Synthetic oligonucleotide
tggaaattgtctcatg

SEQ ID NO: 2808 - DNA, 16 bp, Artificial sequence
  Synthetic oligonucleotide
atggaaattgtctcat

SEQ ID NO: 2809 - DNA, 16 bp, Artificial sequence
  Synthetic oligonucleotide
agtatgtggcaataat

SEQ ID NO: 2810 - DNA, 16 bp, Artificial sequence
  Synthetic oligonucleotide
agagtatgtggcaata

SEQ ID NO: 2811 - DNA, 16 bp, Artificial sequence
  Synthetic oligonucleotide
tagagtatgtggcaat

SEQ ID NO: 2812 - DNA, 16 bp, Artificial sequence
  Synthetic oligonucleotide
tattagagtatgtggc

SEQ ID NO: 2813 - DNA, 16 bp, Artificial sequence
  Synthetic oligonucleotide
atattagagtatgtgg

SEQ ID NO: 2814 - DNA, 16 bp, Artificial sequence
  Synthetic oligonucleotide
tatattagagtatgtg

SEQ ID NO: 2815 - DNA, 16 bp, Artificial sequence
  Synthetic oligonucleotide
tataactgggcaaatt

SEQ ID NO: 2816 - DNA, 16 bp, Artificial sequence
  Synthetic oligonucleotide
aacactgaggtataac

SEQ ID NO: 2817 - DNA, 16 bp, Artificial sequence
  Synthetic oligonucleotide
ttacattaggaacaag

SEQ ID NO: 2818 - DNA, 16 bp, Artificial sequence
  Synthetic oligonucleotide
ttttacattaggaaca

SEQ ID NO: 2819 - DNA, 16 bp, Artificial sequence
  Synthetic oligonucleotide
acttttacattaggaa

SEQ ID NO: 2820 - DNA, 16 bp, Artificial sequence
  Synthetic oligonucleotide
agcacttttacattag

SEQ ID NO: 2821 - DNA, 16 bp, Artificial sequence
  Synthetic oligonucleotide
aagcacttttacatta

SEQ ID NO: 2822 - DNA, 16 bp, Artificial sequence
  Synthetic oligonucleotide
ttaagcacttttacat

SEQ ID NO: 2823 - DNA, 16 bp, Artificial sequence
  Synthetic oligonucleotide
ggaagatctgaaactc

SEQ ID NO: 2824 - DNA, 16 bp, Artificial sequence
  Synthetic oligonucleotide
ttggaagatctgaaac

SEQ ID NO: 2825 - DNA, 16 bp, Artificial sequence
  Synthetic oligonucleotide
tttggaagatctgaaa

SEQ ID NO: 2826 - DNA, 16 bp, Artificial sequence
  Synthetic oligonucleotide
ctttggaagatctgaa

SEQ ID NO: 2827 - DNA, 16 bp, Artificial sequence
  Synthetic oligonucleotide
gtgctttggaagatct

SEQ ID NO: 2828 - DNA, 16 bp, Artificial sequence
  Synthetic oligonucleotide
agtgctttggaagatc

SEQ ID NO: 2829 - DNA, 16 bp, Artificial sequence
  Synthetic oligonucleotide
atagtgctttggaaga

SEQ ID NO: 2830 - DNA, 16 bp, Artificial sequence
  Synthetic oligonucleotide
aggatgcatggttttt

SEQ ID NO: 2831 - DNA, 16 bp, Artificial sequence
  Synthetic oligonucleotide
ttaggatgcatggttt

SEQ ID NO: 2832 - DNA, 16 bp, Artificial sequence
  Synthetic oligonucleotide
tttaggatgcatggtt

SEQ ID NO: 2833 - DNA, 16 bp, Artificial sequence
  Synthetic oligonucleotide
atttaggatgcatggt

SEQ ID NO: 2834 - DNA, 16 bp, Artificial sequence
  Synthetic oligonucleotide
gatttaggatgcatgg

SEQ ID NO: 2835 - DNA, 16 bp, Artificial sequence
  Synthetic oligonucleotide
agatttaggatgcatg

SEQ ID NO: 2836 - DNA, 16 bp, Artificial sequence
  Synthetic oligonucleotide
cagatttaggatgcat

SEQ ID NO: 2837 - DNA, 16 bp, Artificial sequence
  Synthetic oligonucleotide
tcagatttaggatgca

SEQ ID NO: 2838 - DNA, 16 bp, Artificial sequence
  Synthetic oligonucleotide
attcagatttaggatg

SEQ ID NO: 2839 - DNA, 16 bp, Artificial sequence
  Synthetic oligonucleotide
atatggttttgtgtgt

SEQ ID NO: 2840 - DNA, 16 bp, Artificial sequence
  Synthetic oligonucleotide
ttatatggttttgtgt

SEQ ID NO: 2841 - DNA, 16 bp, Artificial sequence
  Synthetic oligonucleotide
tcttatatggttttgt

SEQ ID NO: 2842 - DNA, 16 bp, Artificial sequence
  Synthetic oligonucleotide
ctcttatatggttttg

SEQ ID NO: 2843 - DNA, 16 bp, Artificial sequence
  Synthetic oligonucleotide
attgcaatctgtctga

SEQ ID NO: 2844 - DNA, 16 bp, Artificial sequence
  Synthetic oligonucleotide
atattgcaatctgtct

SEQ ID NO: 2845 - DNA, 16 bp, Artificial sequence
  Synthetic oligonucleotide
aatattgcaatctgtc

SEQ ID NO: 2846 - DNA, 16 bp, Artificial sequence
  Synthetic oligonucleotide
taatattgcaatctgt

SEQ ID NO: 2847 - DNA, 16 bp, Artificial sequence
  Synthetic oligonucleotide
tgtaatattgcaatct

SEQ ID NO: 2848 - DNA, 16 bp, Artificial sequence
  Synthetic oligonucleotide
atgtaatattgcaatc

SEQ ID NO: 2849 - DNA, 16 bp, Artificial sequence
  Synthetic oligonucleotide
tatgtaatattgcaat

SEQ ID NO: 2850 - DNA, 16 bp, Artificial sequence
  Synthetic oligonucleotide
tttatgtaatattgca

SEQ ID NO: 2851 - DNA, 16 bp, Artificial sequence
  Synthetic oligonucleotide
taaggtttcccagatt

SEQ ID NO: 2852 - DNA, 16 bp, Artificial sequence
  Synthetic oligonucleotide
agtaaggtttcccaga

SEQ ID NO: 2853 - DNA, 16 bp, Artificial sequence
  Synthetic oligonucleotide
aagtaaggtttcccag

SEQ ID NO: 2854 - DNA, 16 bp, Artificial sequence
  Synthetic oligonucleotide
taagtaaggtttccca

SEQ ID NO: 2855 - DNA, 16 bp, Artificial sequence
  Synthetic oligonucleotide
actaagtaaggtttcc

SEQ ID NO: 2856 - DNA, 16 bp, Artificial sequence
  Synthetic oligonucleotide
gactaagtaaggtttc

SEQ ID NO: 2857 - DNA, 16 bp, Artificial sequence
  Synthetic oligonucleotide
agactaagtaaggttt

SEQ ID NO: 2858 - DNA, 16 bp, Artificial sequence
  Synthetic oligonucleotide
ttagactaagtaaggt

SEQ ID NO: 2859 - DNA, 16 bp, Artificial sequence
  Synthetic oligonucleotide
actcttatatggtttt

SEQ ID NO: 2860 - DNA, 16 bp, Artificial sequence
  Synthetic oligonucleotide
aactcttatatggttt

SEQ ID NO: 2861 - DNA, 16 bp, Artificial sequence
  Synthetic oligonucleotide
caactcttatatggtt

SEQ ID NO: 2862 - DNA, 16 bp, Artificial sequence
  Synthetic oligonucleotide
gacaactcttatatgg

SEQ ID NO: 2863 - DNA, 16 bp, Artificial sequence
  Synthetic oligonucleotide
tgtatgtcagaagagt

SEQ ID NO: 2864 - DNA, 16 bp, Artificial sequence
  Synthetic oligonucleotide
agtgtatgtcagaaga

SEQ ID NO: 2865 - DNA, 16 bp, Artificial sequence
  Synthetic oligonucleotide
aagtgtatgtcagaag

SEQ ID NO: 2866 - DNA, 16 bp, Artificial sequence
  Synthetic oligonucleotide
aaagtgtatgtcagaa

SEQ ID NO: 2867 - DNA, 16 bp, Artificial sequence
  Synthetic oligonucleotide
taaagtgtatgtcaga

SEQ ID NO: 2868 - DNA, 16 bp, Artificial sequence
  Synthetic oligonucleotide
ttaaagtgtatgtcag

SEQ ID NO: 2869 - DNA, 16 bp, Artificial sequence
  Synthetic oligonucleotide
tttaaagtgtatgtca

SEQ ID NO: 2870 - DNA, 16 bp, Artificial sequence
  Synthetic oligonucleotide
aactttaaagtgtatg

SEQ ID NO: 2871 - DNA, 16 bp, Artificial sequence
  Synthetic oligonucleotide
  misc_feature (1)..(4): bases at these positions are DNA
  misc_feature (6)..(16): bases at these positions are DNA
tgtcucatgccttata

SEQ ID NO: 2872 - DNA, 16 bp, Artificial sequence
  Synthetic oligonucleotide
  misc_feature (1)..(4): bases at these positions are DNA
  misc_feature (6)..(16): bases at these positions are DNA
attguctcatgcctta

SEQ ID NO: 2873 - DNA, 16 bp, Artificial sequence
  Synthetic oligonucleotide
  misc_feature (1)..(4): bases at these positions are DNA
  misc_feature (6)..(16): bases at these positions are DNA
aaatugtctcatgcct

SEQ ID NO: 2874 - DNA, 16 bp, Artificial sequence
  Synthetic oligonucleotide
  misc_feature (1)..(4): bases at these positions are DNA
  misc_feature (6)..(16): bases at these positions are DNA
gaaautgtctcatgcc

SEQ ID NO: 2875 - DNA, 16 bp, Artificial sequence
  Synthetic oligonucleotide
  misc_feature (1)..(4): bases at these positions are DNA
  misc_feature (6)..(16): bases at these positions are DNA
agtaugtggcaataat

SEQ ID NO: 2876 - DNA, 16 bp, Artificial sequence
  Synthetic oligonucleotide
  misc_feature (1)..(4): bases at these positions are DNA
  misc_feature (6)..(16): bases at these positions are DNA
agaguatgtggcaata

SEQ ID NO: 2877 - DNA, 16 bp, Artificial sequence
  Synthetic oligonucleotide
  misc_feature (1)..(4): bases at these positions are DNA
  misc_feature (6)..(16): bases at these positions are DNA
atatuagagtatgtgg

SEQ ID NO: 2878 - DNA, 16 bp, Artificial sequence
  Synthetic oligonucleotide
  misc_feature (1)..(4): bases at these positions are DNA
  misc_feature (6)..(16): bases at these positions are DNA
tatautagagtatgtg

SEQ ID NO: 2879 - DNA, 16 bp, Artificial sequence
  Synthetic oligonucleotide
  misc_feature (1)..(4): bases at these positions are DNA
  misc_feature (6)..(16): bases at these positions are DNA
tctauattagagtatg

SEQ ID NO: 2880 - DNA, 16 bp, Artificial sequence
  Synthetic oligonucleotide
  misc_feature (1)..(4): bases at these positions are DNA
  misc_feature (6)..(16): bases at these positions are DNA
ctttuacattaggaac

SEQ ID NO: 2881 - DNA, 16 bp, Artificial sequence
  Synthetic oligonucleotide
  misc_feature (1)..(4): bases at these positions are DNA
  misc_feature (6)..(16): bases at these positions are DNA
acttutacattaggaa

SEQ ID NO: 2882 - DNA, 16 bp, Artificial sequence
  Synthetic oligonucleotide
  misc_feature (1)..(4): bases at these positions are DNA
  misc_feature (6)..(16): bases at these positions are DNA
cactuttacattagga

SEQ ID NO: 2883 - DNA, 16 bp, Artificial sequence
  Synthetic oligonucleotide
  misc_feature (1)..(4): bases at these positions are DNA
  misc_feature (6)..(16): bases at these positions are DNA
gcacutttacattagg

SEQ ID NO: 2884 - DNA, 16 bp, Artificial sequence
  Synthetic oligonucleotide
  misc_feature (1)..(4): bases at these positions are DNA
  misc_feature (6)..(16): bases at these positions are DNA
ggtauaactgggcaaa

SEQ ID NO: 2885 - DNA, 16 bp, Artificial sequence
  Synthetic oligonucleotide
  misc_feature (1)..(4): bases at these positions are DNA
  misc_feature (6)..(16): bases at these positions are DNA
gagguataactgggca

SEQ ID NO: 2886 - DNA, 16 bp, Artificial sequence
  Synthetic oligonucleotide
  misc_feature (1)..(4): bases at these positions are DNA
  misc_feature (6)..(16): bases at these positions are DNA
gcttuggaagatctga

SEQ ID NO: 2887 - DNA, 16 bp, Artificial sequence
  Synthetic oligonucleotide
  misc_feature (1)..(4): bases at these positions are DNA
  misc_feature (6)..(16): bases at these positions are DNA
tgctutggaagatctg

SEQ ID NO: 2888 - DNA, 16 bp, Artificial sequence
  Synthetic oligonucleotide
  misc_feature (1)..(4): bases at these positions are DNA
  misc_feature (6)..(16): bases at these positions are DNA
gtgcuttggaagatct

SEQ ID NO: 2889 - DNA, 16 bp, Artificial sequence
  Synthetic oligonucleotide
  misc_feature (1)..(4): bases at these positions are DNA
  misc_feature (6)..(16): bases at these positions are DNA
atagugctttggaaga

SEQ ID NO: 2890 - DNA, 16 bp, Artificial sequence
  Synthetic oligonucleotide
  misc_feature (1)..(4): bases at these positions are DNA
  misc_feature (6)..(16): bases at these positions are DNA
aggaugcatggttttt

SEQ ID NO: 2891 - DNA, 16 bp, Artificial sequence
  Synthetic oligonucleotide
  misc_feature (1)..(4): bases at these positions are DNA
  misc_feature (6)..(16): bases at these positions are DNA
gattuaggatgcatgg

SEQ ID NO: 2892 - DNA, 16 bp, Artificial sequence
  Synthetic oligonucleotide
  misc_feature (1)..(4): bases at these positions are DNA
  misc_feature (6)..(16): bases at these positions are DNA
agatutaggatgcatg

SEQ ID NO: 2893 - DNA, 16 bp, Artificial sequence
  Synthetic oligonucleotide
  misc_feature (1)..(4): bases at these positions are DNA
  misc_feature (6)..(16): bases at these positions are DNA
cagauttaggatgcat

SEQ ID NO: 2894 - DNA, 16 bp, Artificial sequence
  Synthetic oligonucleotide
  misc_feature (1)..(4): bases at these positions are DNA
  misc_feature (6)..(16): bases at these positions are DNA
cttauatggttttgtg

SEQ ID NO: 2895 - DNA, 16 bp, Artificial sequence
  Synthetic oligonucleotide
  misc_feature (1)..(4): bases at these positions are DNA
  misc_feature (6)..(16): bases at these positions are DNA
ctctuatatggttttg

SEQ ID NO: 2896 - DNA, 16 bp, Artificial sequence
  Synthetic oligonucleotide
  misc_feature (1)..(4): bases at these positions are DNA
  misc_feature (6)..(16): bases at these positions are DNA
actcutatatggtttt

SEQ ID NO: 2897 - DNA, 16 bp, Artificial sequence
  Synthetic oligonucleotide
  misc_feature (1)..(4): bases at these positions are DNA
  misc_feature (6)..(16): bases at these positions are DNA
caacucttatatggtt

SEQ ID NO: 2898 - DNA, 16 bp, Artificial sequence
  Synthetic oligonucleotide
  misc_feature (1)..(4): bases at these positions are DNA
  misc_feature (6)..(16): bases at these positions are DNA
atatugcaatctgtct

SEQ ID NO: 2899 - DNA, 16 bp, Artificial sequence
  Synthetic oligonucleotide
  misc_feature (1)..(4): bases at these positions are DNA
  misc_feature (6)..(16): bases at these positions are DNA
aatautgcaatctgtc

SEQ ID NO: 2900 - DNA, 16 bp, Artificial sequence
  Synthetic oligonucleotide
  misc_feature (1)..(4): bases at these positions are DNA
  misc_feature (6)..(16): bases at these positions are DNA
gtaauattgcaatctg

SEQ ID NO: 2901 - DNA, 16 bp, Artificial sequence
  Synthetic oligonucleotide
  misc_feature (1)..(4): bases at these positions are DNA
  misc_feature (6)..(16): bases at these positions are DNA
tatguaatattgcaat

SEQ ID NO: 2902 - DNA, 16 bp, Artificial sequence
  Synthetic oligonucleotide
  misc_feature (1)..(4): bases at these positions are DNA
  misc_feature (6)..(16): bases at these positions are DNA
tttaugtaatattgca

SEQ ID NO: 2903 - DNA, 16 bp, Artificial sequence
  Synthetic oligonucleotide
  misc_feature (1)..(4): bases at these positions are DNA
  misc_feature (6)..(16): bases at these positions are DNA
tgtaugtcagaagagt

SEQ ID NO: 2904 - DNA, 16 bp, Artificial sequence
  Synthetic oligonucleotide
  misc_feature (1)..(4): bases at these positions are DNA
  misc_feature (6)..(16): bases at these positions are DNA
agtguatgtcagaaga

SEQ ID NO: 2905 - DNA, 16 bp, Artificial sequence
  Synthetic oligonucleotide
  misc_feature (1)..(4): bases at these positions are DNA
  misc_feature (6)..(16): bases at these positions are DNA
aaagugtatgtcagaa

SEQ ID NO: 2906 - DNA, 16 bp, Artificial sequence
  Synthetic oligonucleotide
  misc_feature (1)..(4): bases at these positions are DNA
  misc_feature (6)..(16): bases at these positions are DNA
aactutaaagtgtatg

SEQ ID NO: 2907 - DNA, 16 bp, Artificial sequence
  Synthetic oligonucleotide
  misc_feature (1)..(4): bases at these positions are DNA
  misc_feature (6)..(16): bases at these positions are DNA
taaguaaggtttccca

SEQ ID NO: 2908 - DNA, 16 bp, Artificial sequence
  Synthetic oligonucleotide
  misc_feature (1)..(4): bases at these positions are DNA
  misc_feature (6)..(16): bases at these positions are DNA
agacuaagtaaggttt

SEQ ID NO: 2909 - DNA, 16 bp, Artificial sequence
  Synthetic oligonucleotide
  misc_feature (1)..(5): bases at these positions are DNA
  misc_feature (7)..(16): bases at these positions are DNA
aattguctcatgcctt

SEQ ID NO: 2910 - DNA, 16 bp, Artificial sequence
  Synthetic oligonucleotide
  misc_feature (1)..(5): bases at these positions are DNA
  misc_feature (7)..(16): bases at these positions are DNA
tagaguatgtggcaat

SEQ ID NO: 2911 - DNA, 16 bp, Artificial sequence
  Synthetic oligonucleotide
  misc_feature (1)..(5): bases at these positions are DNA
  misc_feature (7)..(16): bases at these positions are DNA
tatatuagagtatgtg

SEQ ID NO: 2912 - DNA, 16 bp, Artificial sequence
  Synthetic oligonucleotide
  misc_feature (1)..(5): bases at these positions are DNA
  misc_feature (7)..(16): bases at these positions are DNA
gaaatugtctcatgcc

SEQ ID NO: 2913 - DNA, 16 bp, Artificial sequence
  Synthetic oligonucleotide
  misc_feature (1)..(5): bases at these positions are DNA
  misc_feature (7)..(16): bases at these positions are DNA
ggaaautgtctcatgc

SEQ ID NO: 2914 - DNA, 16 bp, Artificial sequence
  Synthetic oligonucleotide
  misc_feature (1)..(5): bases at these positions are DNA
  misc_feature (7)..(16): bases at these positions are DNA
aggtauaactgggcaa

SEQ ID NO: 2915 - DNA, 16 bp, Artificial sequence
  Synthetic oligonucleotide
  misc_feature (1)..(5): bases at these positions are DNA
  misc_feature (7)..(16): bases at these positions are DNA
tgagguataactgggc

SEQ ID NO: 2916 - DNA, 16 bp, Artificial sequence
  Synthetic oligonucleotide
  misc_feature (1)..(5): bases at these positions are DNA
  misc_feature (7)..(16): bases at these positions are DNA
aacacugaggtataac

SEQ ID NO: 2917 - DNA, 16 bp, Artificial sequence
  Synthetic oligonucleotide
  misc_feature (1)..(5): bases at these positions are DNA
  misc_feature (7)..(16): bases at these positions are DNA
ttacautaggaacaag

SEQ ID NO: 2918 - DNA, 16 bp, Artificial sequence
  Synthetic oligonucleotide
  misc_feature (1)..(5): bases at these positions are DNA
  misc_feature (7)..(16): bases at these positions are DNA
actttuacattaggaa

SEQ ID NO: 2919 - DNA, 16 bp, Artificial sequence
  Synthetic oligonucleotide
  misc_feature (1)..(5): bases at these positions are DNA
  misc_feature (7)..(16): bases at these positions are DNA
cacttutacattagga

SEQ ID NO: 2920 - DNA, 16 bp, Artificial sequence
  Synthetic oligonucleotide
  misc_feature (1)..(5): bases at these positions are DNA
  misc_feature (7)..(16): bases at these positions are DNA
gcactuttacattagg

SEQ ID NO: 2921 - DNA, 16 bp, Artificial sequence
  Synthetic oligonucleotide
  misc_feature (1)..(5): bases at these positions are DNA
  misc_feature (7)..(16): bases at these positions are DNA
agcacutttacattag

SEQ ID NO: 2922 - DNA, 16 bp, Artificial sequence
  Synthetic oligonucleotide
  misc_feature (1)..(5): bases at these positions are DNA
  misc_feature (7)..(16): bases at these positions are DNA
tgcttuggaagatctg

SEQ ID NO: 2923 - DNA, 16 bp, Artificial sequence
  Synthetic oligonucleotide
  misc_feature (1)..(5): bases at these positions are DNA
  misc_feature (7)..(16): bases at these positions are DNA
gtgctutggaagatct

SEQ ID NO: 2924 - DNA, 16 bp, Artificial sequence
  Synthetic oligonucleotide
  misc_feature (1)..(5): bases at these positions are DNA
  misc_feature (7)..(16): bases at these positions are DNA
agtgcuttggaagatc

SEQ ID NO: 2925 - DNA, 16 bp, Artificial sequence
  Synthetic oligonucleotide
  misc_feature (1)..(5): bases at these positions are DNA
  misc_feature (7)..(16): bases at these positions are DNA
agattuaggatgcatg

SEQ ID NO: 2926 - DNA, 16 bp, Artificial sequence
  Synthetic oligonucleotide
  misc_feature (1)..(5): bases at these positions are DNA
  misc_feature (7)..(16): bases at these positions are DNA
cagatutaggatgcat

SEQ ID NO: 2927 - DNA, 16 bp, Artificial sequence
  Synthetic oligonucleotide
  misc_feature (1)..(5): bases at these positions are DNA
  misc_feature (7)..(16): bases at these positions are DNA
tcagauttaggatgca

SEQ ID NO: 2928 - DNA, 16 bp, Artificial sequence
  Synthetic oligonucleotide
  misc_feature (1)..(5): bases at these positions are DNA
  misc_feature (7)..(16): bases at these positions are DNA
ttatauggttttgtgt

SEQ ID NO: 2929 - DNA, 16 bp, Artificial sequence
  Synthetic oligonucleotide
  misc_feature (1)..(5): bases at these positions are DNA
  misc_feature (7)..(16): bases at these positions are DNA
tcttauatggttttgt

SEQ ID NO: 2930 - DNA, 16 bp, Artificial sequence
  Synthetic oligonucleotide
  misc_feature (1)..(5): bases at these positions are DNA
  misc_feature (7)..(16): bases at these positions are DNA
actctuatatggtttt

SEQ ID NO: 2931 - DNA, 16 bp, Artificial sequence
  Synthetic oligonucleotide
  misc_feature (1)..(5): bases at these positions are DNA
  misc_feature (7)..(16): bases at these positions are DNA
aactcutatatggttt

SEQ ID NO: 2932 - DNA, 16 bp, Artificial sequence
  Synthetic oligonucleotide
  misc_feature (1)..(5): bases at these positions are DNA
  misc_feature (7)..(16): bases at these positions are DNA
aatatugcaatctgtc

SEQ ID NO: 2933 - DNA, 16 bp, Artificial sequence
  Synthetic oligonucleotide
  misc_feature (1)..(5): bases at these positions are DNA
  misc_feature (7)..(16): bases at these positions are DNA
taatautgcaatctgt

SEQ ID NO: 2934 - DNA, 16 bp, Artificial sequence
  Synthetic oligonucleotide
  misc_feature (1)..(5): bases at these positions are DNA
  misc_feature (7)..(16): bases at these positions are DNA
tgtaauattgcaatct

SEQ ID NO: 2935 - DNA, 16 bp, Artificial sequence
  Synthetic oligonucleotide
  misc_feature (1)..(5): bases at these positions are DNA
  misc_feature (7)..(16): bases at these positions are DNA
aagtguatgtcagaag

SEQ ID NO: 2936 - DNA, 16 bp, Artificial sequence
  Synthetic oligonucleotide
  misc_feature (1)..(5): bases at these positions are DNA
  misc_feature (7)..(16): bases at these positions are DNA
taaagugtatgtcaga

SEQ ID NO: 2937 - DNA, 16 bp, Artificial sequence
  Synthetic oligonucleotide
  misc_feature (1)..(5): bases at these positions are DNA
  misc_feature (7)..(16): bases at these positions are DNA
aacttuaaagtgtatg

SEQ ID NO: 2938 - DNA, 16 bp, Artificial sequence
  Synthetic oligonucleotide
  misc_feature (1)..(5): bases at these positions are DNA
  misc_feature (7)..(16): bases at these positions are DNA
taagguttcccagatt

SEQ ID NO: 2939 - DNA, 16 bp, Artificial sequence
  Synthetic oligonucleotide
  misc_feature (1)..(5): bases at these positions are DNA
  misc_feature (7)..(16): bases at these positions are DNA
ctaaguaaggtttccc

SEQ ID NO: 2940 - DNA, 16 bp, Artificial sequence
  Synthetic oligonucleotide
cgccgataaggtacac

What is claimed:
1. A modified oligonucleotide according to the following chemical structure:
(SEQ ID NO: 2865)
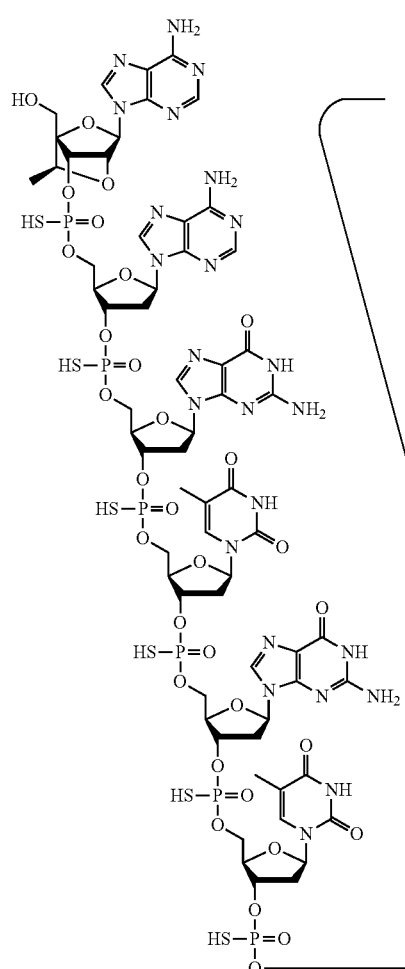
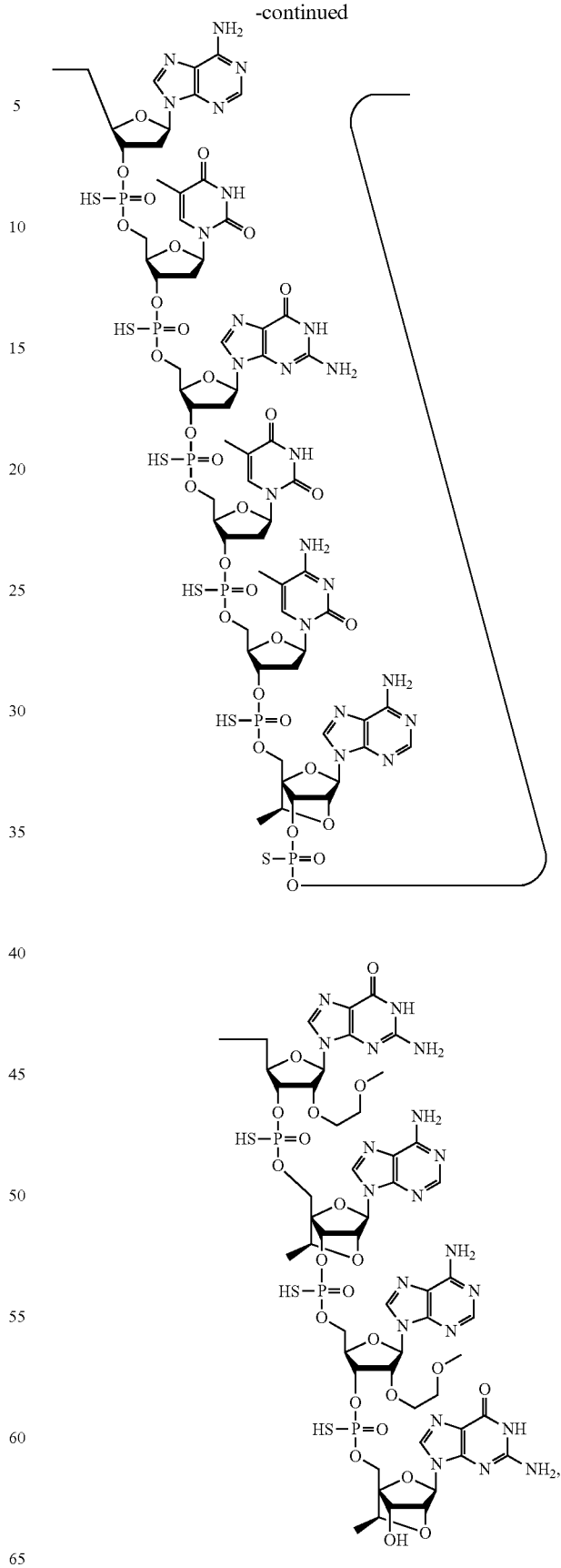
or a salt thereof.

2. A modified oligonucleotide according to the following chemical structure:

(SEQ ID NO: 2865)

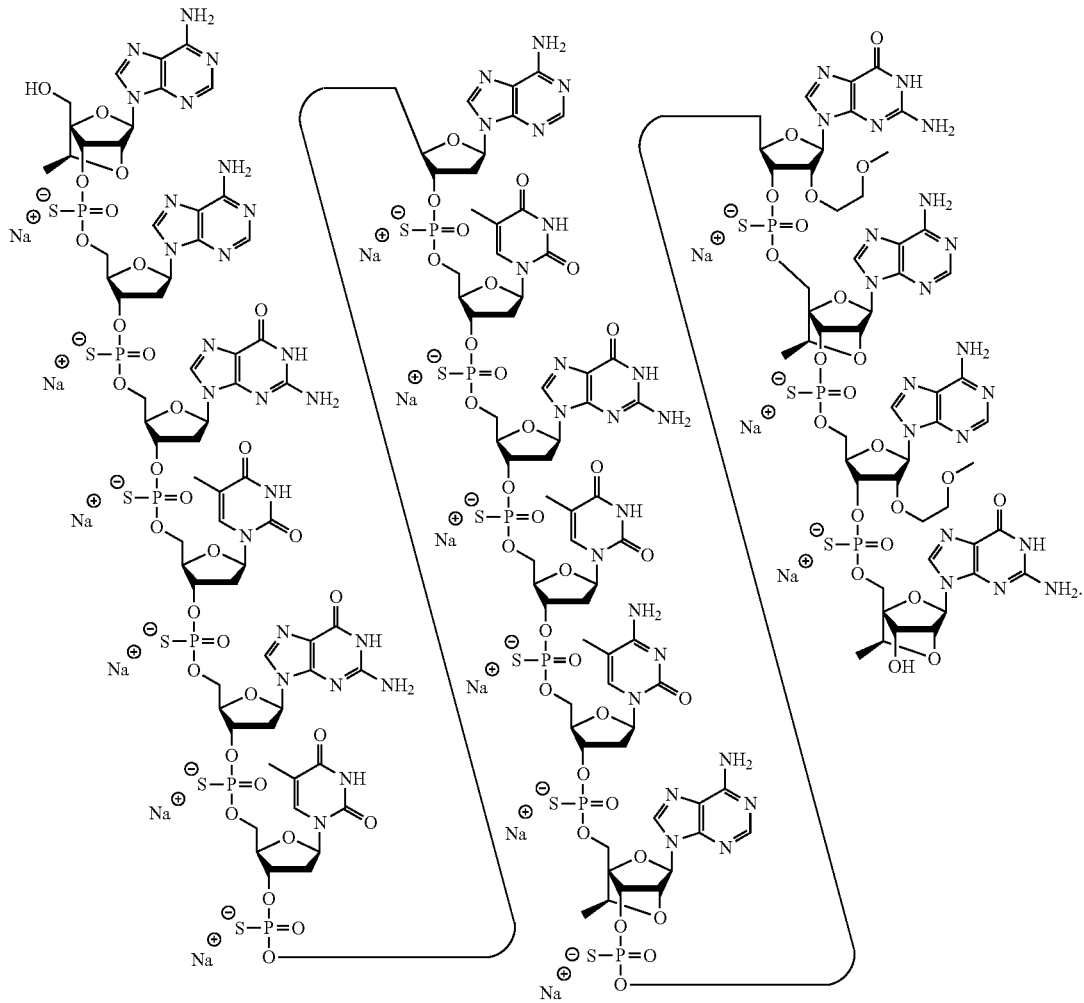

3. A combination comprising the modified oligonucleotide of claim 1 and a secondary agent.

4. The combination of claim 3, wherein the secondary agent is a CDK4/6 inhibitor.

5. The combination of claim 4, wherein the CDK4/6 inhibitor is palbociclib, ribociclib, or abemaciclib.

6. The combination of claim 3, wherein the secondary agent is an EGFR inhibitor.

7. The combination of claim 6, wherein the EGFR inhibitor is cetuximab, necitumumab, panitumumab, vandetanib, dacomitinib, neratinib, osimertinib, gefitinib, lapatinib, or erlotinib.

8. The combination of claim 3, wherein the secondary agent is a kinase inhibitor.

9. The combination of claim 8, wherein the kinase inhibitor is sorafenib, regorafenib, or carbozantinib.

10. A pharmaceutical composition, comprising the modified oligonucleotide of claim 1 and a pharmaceutically acceptable diluent or carrier.

11. A pharmaceutical composition, comprising the modified oligonucleotide of claim 1 and water.

12. A pharmaceutical composition, comprising the modified oligonucleotide of claim 2 and a pharmaceutically acceptable diluent or carrier.

13. A pharmaceutical composition, comprising the modified oligonucleotide of claim 2 and water.

14. An oligomeric compound comprising a modified oligonucleotide consisting of 16 linked nucleosides having the nucleobase sequence recited in SEQ ID NO: 2865, wherein the modified oligonucleotide has:
a gap segment consisting of ten linked 2'-deoxynucleosides;
a 5' wing segment consisting of one linked nucleoside; and
a 3' wing segment consisting of five linked nucleosides;
wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine.

15. A pharmaceutical composition, comprising the oligomeric compound of claim 14 and a pharmaceutically acceptable diluent or carrier.

16. A pharmaceutical composition, comprising the oligomeric compound of claim 14 and water.

17. A method of inhibiting expression of YAP1 in a cell, comprising contacting the cell with the oligomeric compound of claim 14, thereby inhibiting expression of YAP1 in the cell.

18. The method of claim 17, wherein the cell is a cancer cell.

19. A method of inhibiting expression of YAP1 in a cell, comprising contacting the cell with the modified oligonucleotide of claim 1, thereby inhibiting expression of YAP1 in the cell.

20. The method of claim 19, wherein the cell is a cancer cell.

21. A method of inhibiting expression of YAP1 in a cell, comprising contacting the cell with the modified oligonucleotide of claim 2, thereby inhibiting expression of YAP1 in the cell.

22. The method of claim 21, wherein the cell is a cancer cell.

23. The modified oligonucleotide of claim 1, which is the sodium salt or the potassium salt.

* * * * *